United States Patent 12,152,077 (IMMUNOTHERAPY TARGETING TUMOR NEOANTIGENIC PEPTIDES) - sequence listing, part 5

SEQ ID NO: 13207 - DNA, 636 bp, synthetic construct; identical to SEQ ID NO: 817
  misc_feature 1..636: note = Synthetic polypeptide
  source 1..636: mol_type = other DNA

SEQ ID NO: 13208 - DNA, 582 bp, synthetic construct; identical to SEQ ID NO: 819
  misc_feature 1..582: note = Synthetic polypeptide
  source 1..582: mol_type = other DNA

SEQ ID NO: 13209 - DNA, 3241 bp, synthetic construct
  misc_feature 1..3241: note = Synthetic polypeptide
  source 1..3241: mol_type = other DNA
agctgaaaccctcaaggcttatggggcccagcctgacctgtcgcctgctctcctctgattccgtctcctaccattctttccattgctcaatcctccagccatactggcctcctctctcttccttgaaatccaccactcctgcctcaaggcctttccacttgctgtagcctgtctagaagactcttccccaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctga

SEQ ID NO: 13210 - DNA, 565 bp, synthetic construct
  misc_feature 1..565: note = Synthetic polypeptide
  source 1..565: mol_type = other DNA
agctgaaaccctcaaggcttatggggcccagcctgacctgtcgcctgctctcctctgattccgtctcctaccattctttccattgctcaatcctccagccatactggcctcctctctcttccttgaaatccaccactcctgcctcaaggcctttccacttgctgtagcctgtctagaagactcttccccaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaagactcacagaaagagctggcctga

SEQ ID NO: 13211 - DNA, 721 bp, synthetic construct; identical to SEQ ID NO: 10080
  misc_feature 1..721: note = Synthetic polypeptide
  source 1..721: mol_type = other DNA

SEQ ID NO: 13212 - DNA, 706 bp, synthetic construct; identical to SEQ ID NO: 10081
  misc_feature 1..706: note = Synthetic polypeptide
  source 1..706: mol_type = other DNA

SEQ ID NO: 13213 - DNA, 526 bp, synthetic construct; identical to SEQ ID NO: 10082
  misc_feature 1..526: note = Synthetic polypeptide
  source 1..526: mol_type = other DNA

SEQ ID NO: 13214 - DNA, 487 bp, synthetic construct; identical to SEQ ID NO: 10083
  misc_feature 1..487: note = Synthetic polypeptide
  source 1..487: mol_type = other DNA

SEQ ID NO: 13215 - DNA, 667 bp, synthetic construct; identical to SEQ ID NO: 10084
  misc_feature 1..667: note = Synthetic polypeptide
  source 1..667: mol_type = other DNA

SEQ ID NO: 13216 - DNA, 592 bp, synthetic construct; identical to SEQ ID NO: 10085
  misc_feature 1..592: note = Synthetic polypeptide
  source 1..592: mol_type = other DNA

SEQ ID NO: 13217 - DNA, 1107 bp, synthetic construct
  misc_feature 1..1107: note = Synthetic polypeptide
  source 1..1107: mol_type = other DNA
ggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataa

SEQ ID NO: 13218 - DNA, 760 bp, synthetic construct
  misc_feature 1..760: note = Synthetic polypeptide
  source 1..760: mol_type = other DNA
ggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctgggg

SEQ ID NO: 13219 - DNA, 1681 bp, synthetic construct; identical to SEQ ID NO: 8523
  misc_feature 1..1681: note = Synthetic polypeptide
  source 1..1681: mol_type = other DNA

SEQ ID NO: 13220 - DNA, 226 bp, synthetic construct
  misc_feature 1..226: note = Synthetic polypeptide
  source 1..226: mol_type = other DNA
gatcaatgaagactaaatataaaaaacattttcttgaatggcatgctagtagcagtgagcaaagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaa

SEQ ID NO: 13221 - DNA, 129 bp, synthetic construct
  misc_feature 1..129: note = Synthetic polypeptide
  source 1..129: mol_type = other DNA
gatcaatgaagactaaatataaaaaacattttcttgaatggcatgctagtagcagtgagcaaagcctgaggttgcagactggtctgaaggtgtacaggtgccctctgtgcctattcagcaattccctac

SEQ ID NO: 13222 - DNA, 1739 bp, synthetic construct
  misc_feature 1..1739: note = Synthetic polypeptide
  source 1..1739: mol_type = other DNA
gccgggcgtggtggcttacgcctgtaatcccagcactttgggaggccaaggcgggcggatcaggagttcaagaccagcctggccaacatggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 13223 - DNA, 643 bp, synthetic construct
  misc_feature 1..643: note = Synthetic polypeptide
  source 1..643: mol_type = other DNA
ctgcctcatcttagcagtaattaataatcactcatggatccatgaactaaggagctggagatagcctcagaacagctcattcagagatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 13224 - DNA, 976 bp, synthetic construct
  misc_feature 1..976: note = Synthetic polypeptide
  source 1..976: mol_type = other DNA
ttaatcccccgaagcctccgtttccacatgttcttgacaagatagacttttctgagtcttttggggactaaatgaaacagtggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctga

SEQ ID NO: 13225 - DNA, 823 bp, synthetic construct
  misc_feature 1..823: note = Synthetic polypeptide
  source 1..823: mol_type = other DNA
ttaatcccccgaagcctccgtttccacatgttcttgacaagatagacttttctgagtcttttggggactaaatgaaacagtggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctga

SEQ ID NO: 13226 - DNA, 682 bp, synthetic construct
  misc_feature 1..682: note = Synthetic polypeptide
  source 1..682: mol_type = other DNA
atgcctgtaatcccagcactttgggaggctgaggccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtga

SEQ ID NO: 13227 - DNA, 854 bp, synthetic construct; identical to SEQ ID NO: 6577
  misc_feature 1..854: note = Synthetic polypeptide
  source 1..854: mol_type = other DNA

SEQ ID NO: 13228 - DNA, 1100 bp, synthetic construct
  misc_feature 1..1100: note = Synthetic polypeptide
  source 1..1100: mol_type = other DNA
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13229 - DNA, 183 bp, synthetic construct
  misc_feature 1..183: note = Synthetic polypeptide
  source 1..183: mol_type = other DNA
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataa

SEQ ID NO: 13230 - DNA, 1184 bp, synthetic construct
  misc_feature 1..1184: note = Synthetic polypeptide
  source 1..1184: mol_type = other DNA
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaaggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13231 - DNA, 1100 bp, synthetic construct
  misc_feature 1..1100: note = Synthetic polypeptide
  source 1..1100: mol_type = other DNA
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaagaaggattctgtttcacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13232 - DNA, 2651 bp, synthetic construct
  misc_feature 1..2651: note = Synthetic polypeptide
  source 1..2651: mol_type = other DNA
gctggtcacagtggctcatgcctgtaatcccagcactttgggaggccaaggcaggcggattgcttgagcccatgagatggagatgagcctggacaacatgggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctga

SEQ ID NO: 13233 - DNA, 286 bp, synthetic construct
  misc_feature 1..286: note = Synthetic polypeptide
  source 1..286: mol_type = other DNA
cactgcgcccagcctccagatgcttttaaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtga

SEQ ID NO: 13234 - DNA, 316 bp, synthetic construct
  misc_feature 1..316: note = Synthetic polypeptide
  source 1..316: mol_type = other DNA
cactgcgcccagcctccagatgcttttaaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtga

SEQ ID NO: 13235 - DNA, 828 bp, synthetic construct
  misc_feature 1..828: note = Synthetic polypeptide
  source 1..828: mol_type = other DNA
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtga

SEQ ID NO: 13236 - DNA, 939 bp, synthetic construct
  misc_feature 1..939: note = Synthetic polypeptide
  source 1..939: mol_type = other DNA
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatag

SEQ ID NO: 13237 - DNA, 951 bp, synthetic construct
  misc_feature 1..951: note = Synthetic polypeptide
  source 1..951: mol_type = other DNA
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagcctcacaggccaaagcatcagcaccagaacgcacacccagcccagccccaaagagaaagaagagacagcaaagagccgcagccggtgcttgcacaccgccttgcacatagcagaggctccgggctga

SEQ ID NO: 13238 - DNA, 91 bp, synthetic construct
  misc_feature 1..91: note = Synthetic polypeptide
  source 1..91: mol_type = other DNA
tccactcctttctcttcagcccctcggacactgcctagcctcgatgacttacgagccctcaaggggaagcattttctcctggaccccttga

SEQ ID NO: 13239 - DNA, 497 bp, synthetic construct
  misc_feature 1..497: note = Synthetic polypeptide
  source 1..497: mol_type = other DNA
gttgcgccgccccggccaagcctcagcctttctgggccttagcttcttcacgtgtaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13240 - DNA, 398 bp, synthetic construct
  misc_feature 1..398: note = Synthetic polypeptide
  source 1..398: mol_type = other DNA
gttgcgccgccccggccaagcctcagcctttctgggccttagcttcttcacgtgtaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13241 - DNA, 285 bp, synthetic construct; identical to SEQ ID NO: 6932
  misc_feature 1..285: note = Synthetic polypeptide
  source 1..285: mol_type = other DNA

SEQ ID NO: 13242 - DNA, 333 bp, synthetic construct; identical to SEQ ID NO: 6933
  misc_feature 1..333: note = Synthetic polypeptide
  source 1..333: mol_type = other DNA

SEQ ID NO: 13243 - DNA, 207 bp, synthetic construct; identical to SEQ ID NO: 6934
  misc_feature 1..207: note = Synthetic polypeptide
  source 1..207: mol_type = other DNA

SEQ ID NO: 13244 - DNA, 555 bp, synthetic construct; identical to SEQ ID NO: 6935
  misc_feature 1..555: note = Synthetic polypeptide
  source 1..555: mol_type = other DNA

SEQ ID NO: 13245 - DNA, 225 bp, synthetic construct; identical to SEQ ID NO: 6936
  misc_feature 1..225: note = Synthetic polypeptide
  source 1..225: mol_type = other DNA

SEQ ID NO: 13246 - DNA, 665 bp, synthetic construct; identical to SEQ ID NO: 6745
  misc_feature 1..665: note = Synthetic polypeptide
  source 1..665: mol_type = other DNA

SEQ ID NO: 13247 - DNA, 369 bp, synthetic construct
  misc_feature 1..369: note = Synthetic polypeptide
  source 1..369: mol_type = other DNA
ggctgggcccagtagctcgtgcctgtaatcccagcattttggtaggctgaggcgggtggatggctcgagctcaggagttcgagagcagcctgggtaacatggcgaaacccctcccccccccccccccccgtctccaaaaaatacaatagccagcgtggtgcagccgtctgtagtcccagctactctggaggctcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 13248 - DNA, 509 bp, synthetic construct; identical to SEQ ID NO: 7445
  misc_feature 1..509: note = Synthetic polypeptide
  source 1..509: mol_type = other DNA

SEQ ID NO: 13249 - DNA, 1198 bp, synthetic construct
  misc_feature 1..1198: note = Synthetic polypeptide
  source 1..1198: mol_type = other DNA
cagtggttcttaactaggggtgattctatttcttcttctcctgagggaacatgtggcaatctcaagagacatttttggttgccaggggaagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctga

SEQ ID NO: 13250 - DNA, 587 bp, synthetic construct; identical to SEQ ID NO: 10160
  misc_feature 1..587: note = Synthetic polypeptide
  source 1..587: mol_type = other DNA

SEQ ID NO: 13251 - DNA, 1246 bp, synthetic construct; identical to SEQ ID NO: 10161
  misc_feature 1..1246: note = Synthetic polypeptide
  source 1..1246: mol_type = other DNA

SEQ ID NO: 13252 - DNA, 1768 bp, synthetic construct; identical to SEQ ID NO: 10162
  misc_feature 1..1768: note = Synthetic polypeptide
  source 1..1768: mol_type = other DNA

SEQ ID NO: 13253 - DNA, 1054 bp, synthetic construct; identical to SEQ ID NO: 10163
  misc_feature 1..1054: note = Synthetic polypeptide
  source 1..1054: mol_type = other DNA

SEQ ID NO: 13254 - DNA, 553 bp, synthetic construct; identical to SEQ ID NO: 10164
  misc_feature 1..553: note = Synthetic polypeptide
  source 1..553: mol_type = other DNA

SEQ ID NO: 13255 - DNA, 118 bp, synthetic construct
  misc_feature 1..118: note = Synthetic polypeptide
  source 1..118: mol_type = other DNA
caggggatccgagccaggagacactgagcctttggagttaggaggtcctggagcagaacctgaacagaaagaacaatcgacaggacagaagcggcctttgaagaacgacgaactataa

SEQ ID NO: 13256 - DNA, 2395 bp, synthetic construct
  misc_feature 1..2395: note = Synthetic polypeptide
  source 1..2395: mol_type = other DNA
atcctggagtacctgtctggtacctggtacccggcacactgtgagttcctggacatcaagggctggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactga

SEQ ID NO: 13257 - DNA, 333 bp, synthetic construct
  misc_feature 1..333: note = Synthetic polypeptide
  source 1..333: mol_type = other DNA
gagacagtttgcggctgtggaaacacacgtgctcgcaaatcaaagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctga

SEQ ID NO: 13258 - DNA, 393 bp, synthetic construct
  misc_feature 1..393: note = Synthetic polypeptide
  source 1..393: mol_type = other DNA
accagttacctcatctttaacatgaagaaaataagagctacccccagggctgttttaaggagtaaatgaataatggacatgaacatttaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataa

SEQ ID NO: 13259 - DNA, 1003 bp, synthetic construct
  misc_feature 1..1003: note = Synthetic polypeptide
  source 1..1003: mol_type = other DNA
caggaagtccccttcattgctgtgtggacgtggtagataaagtgttctcaagctggaaagatttaacagattggcccctcggggacctggacattgaatattttactgatggaagcagtttcgtactaaggggagtctgccgagctgggtatgccgcggtgactttggactcagcagtagaggtaccgtctctgtctgcagaaacttctgcttagaaagcagagctaatagctctgacaagagctctctggctaggaaaagagcagaaggcaagtatttacacagattccaaatatgcttctgccactttgcatgttcatgaggctgtttacaaagaataaaagacttttaacggctggaagtgaaaaaacaaagtataaggaggaaattccacctctgttaaacgctgtgtgggccctggaagaggtggcagtgatgcgctgcaggaggccccgaaaagcagcaaagcagaaaggcagacgaagaggcaaacgggctgcaacgacaactccaccttctagagaggaagccttagctatgcctcccgctcccggagattcccctcctggggatcccaaggtcccctccaaacgaaaagtcttggtttgcccacaagaataagaactacattgaagaaagatgtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 13260 - DNA, 812 bp, synthetic construct; identical to SEQ ID NO: 693
  misc_feature 1..812: note = Synthetic polypeptide
  source 1..812: mol_type = other DNA

SEQ ID NO: 13261 - DNA, 752 bp, synthetic construct; identical to SEQ ID NO: 694
  misc_feature 1..752: note = Synthetic polypeptide
  source 1..752: mol_type = other DNA

SEQ ID NO: 13262 - DNA, 149 bp, synthetic construct
  misc_feature 1..149: note = Synthetic polypeptide
  source 1..149: mol_type = other DNA
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaa

SEQ ID NO: 13263 - DNA, 627 bp, synthetic construct
  misc_feature 1..627: note = Synthetic polypeptide
  source 1..627: mol_type = other DNA
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaa

SEQ ID NO: 13264 - DNA, 822 bp, synthetic construct
  misc_feature 1..822: note = Synthetic polypeptide
  source 1..822: mol_type = other DNA
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttga

SEQ ID NO: 13265 - DNA, 300 bp, synthetic construct
  misc_feature 1..300: note = Synthetic polypeptide
  source 1..300: mol_type = other DNA
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatag

SEQ ID NO: 13266 - DNA, 750 bp, synthetic construct
  misc_feature 1..750: note = Synthetic polypeptide
  source 1..750: mol_type = other DNA
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccagggaaacaccatccaggacgcacctcaccccctcaccctgctccatcccagcaggaccctcattcacaccaagtccccttggggccagaagttgcttgagttcataaaacatgtctgttatcacagacatcagagccacaggccgtgcgctccagggtggttttgccaagtgctgcagaggccaggtgctgtctcaggagagaagacccagcagacccggccagcccctccagccacctgtctgctctgcctctcgtgcctctcaggcttccggcatgggccgtggaggtcacaggctctgcccagtgacctcgtggccccactgtttgtcagttacactgtggaggtgagcatcacaaacgcagggtggagttttcccgcagctgtgtga

SEQ ID NO: 13267 - DNA, 249 bp, synthetic construct; identical to SEQ ID NO: 12109
  misc_feature 1..249: note = Synthetic polypeptide
  source 1..249: mol_type = other DNA

SEQ ID NO: 13268 - DNA, 198 bp, synthetic construct; identical to SEQ ID NO: 12110
  misc_feature 1..198: note = Synthetic polypeptide
  source 1..198: mol_type = other DNA

SEQ ID NO: 13269 - DNA, 394 bp, synthetic construct; identical to SEQ ID NO: 8700
  misc_feature 1..394: note = Synthetic polypeptide
  source 1..394: mol_type = other DNA

SEQ ID NO: 13270 - DNA, 147 bp, synthetic construct; identical to SEQ ID NO: 8977
  misc_feature 1..147: note = Synthetic polypeptide
  source 1..147: mol_type = other DNA

SEQ ID NO: 13271 - DNA, 144 bp, synthetic construct; identical to SEQ ID NO: 8978
  misc_feature 1..144: note = Synthetic polypeptide
  source 1..144: mol_type = other DNA

SEQ ID NO: 13272 - DNA, 1226 bp, synthetic construct; identical to SEQ ID NO: 12573
  misc_feature 1..1226: note = Synthetic polypeptide
  source 1..1226: mol_type = other DNA

SEQ ID NO: 13273 - DNA, 170 bp, synthetic construct; identical to SEQ ID NO: 12574
  misc_feature 1..170: note = Synthetic polypeptide
  source 1..170: mol_type = other DNA

SEQ ID NO: 13274 - DNA, 446 bp, synthetic construct
  misc_feature 1..446: note = Synthetic polypeptide
  source 1..446: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatga

SEQ ID NO: 13275 - DNA, 281 bp, synthetic construct
  misc_feature 1..281: note = Synthetic polypeptide
  source 1..281: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggct

SEQ ID NO: 13276 - DNA, 401 bp, synthetic construct
  misc_feature 1..401: note = Synthetic polypeptide
  source 1..401: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggac

SEQ ID NO: 13277 - DNA, 383 bp, synthetic construct
  misc_feature 1..383: note = Synthetic polypeptide
  source 1..383: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgaggacttccggaataaagtggatgactacatcaaacgttatgccagatga

SEQ ID NO: 13278 - DNA, 194 bp, synthetic construct
  misc_feature 1..194: note = Synthetic polypeptide
  source 1..194: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgtttattgagagaacattcaattga

SEQ ID NO: 13279 - DNA, 260 bp, synthetic construct
  misc_feature 1..260: note = Synthetic polypeptide
  source 1..260: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatgtcgtttggggattaa

SEQ ID NO: 13280 - DNA, 284 bp, synthetic construct
  misc_feature 1..284: note = Synthetic polypeptide
  source 1..284: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtggatcttttgaattttgatgatccactgaatattgaagctgcagaacatcatttgcgggacaaggaggacttccggaataaagtggatgactacatcaaacgttatgccagatga

SEQ ID NO: 13281 - DNA, 251 bp, synthetic construct
  misc_feature 1..251: note = Synthetic polypeptide
  source 1..251: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatcttttga

SEQ ID NO: 13282 - DNA, 403 bp, synthetic construct
  misc_feature 1..403: note = Synthetic polypeptide
  source 1..403: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 13283 - DNA, 377 bp, synthetic construct
  misc_feature 1..377: note = Synthetic polypeptide
  source 1..377: mol_type = other DNA
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaa

SEQ ID NO: 13284 - DNA, 315 bp, synthetic construct
  misc_feature 1..315: note = Synthetic polypeptide
  source 1..315: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatc

SEQ ID NO: 13285 - DNA, 1020 bp, synthetic construct
  misc_feature 1..1020: note = Synthetic polypeptide
  source 1..1020: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctga

SEQ ID NO: 13286 - DNA, 702 bp, synthetic construct
  misc_feature 1..702: note = Synthetic polypeptide
  source 1..702: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagact

SEQ ID NO: 13287 - DNA, 493 bp, synthetic construct
  misc_feature 1..493: note = Synthetic polypeptide
  source 1..493: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgc

SEQ ID NO: 13288 - DNA, 71 bp, synthetic construct
  misc_feature 1..71: note = Synthetic polypeptide
  source 1..71: mol_type = other DNA
agctctgtgaccttatgctccacactaactctggcagagcctccgtttcctcatagcacaaagatgcagat

SEQ ID NO: 13289 - DNA, 57 bp, synthetic construct
  misc_feature 1..57: note = Synthetic polypeptide
  source 1..57: mol_type = other DNA
agctctgtgaccttatgctccacactaactctggcagagcctccgtttcctcatagc

SEQ ID NO: 13290 - DNA, 232 bp, synthetic construct
  misc_feature 1..232: note = Synthetic polypeptide
  source 1..232: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacacct

SEQ ID NO: 13291 - DNA, 270 bp, synthetic construct
  misc_feature 1..270: note = Synthetic polypeptide
  source 1..270: mol_type = other DNA
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacact

SEQ ID NO: 13292 - DNA, 892 bp, synthetic construct; identical to SEQ ID NO: 12685
  misc_feature 1..892: note = Synthetic polypeptide
  source 1..892: mol_type = other DNA

SEQ ID NO: 13293 - DNA, 1075 bp, synthetic construct; identical to SEQ ID NO: 12686
  misc_feature 1..1075: note = Synthetic polypeptide
  source 1..1075: mol_type = other DNA

SEQ ID NO: 13294 - DNA, 197 bp, synthetic construct; identical to SEQ ID NO: 12687
  misc_feature 1..197: note = Synthetic polypeptide
  source 1..197: mol_type = other DNA

SEQ ID NO: 13295 - DNA, 769 bp, synthetic construct; identical to SEQ ID NO: 12688
  misc_feature 1..769: note = Synthetic polypeptide
  source 1..769: mol_type = other DNA

SEQ ID NO: 13296 - DNA, 952 bp, synthetic construct; identical to SEQ ID NO: 12689
  misc_feature 1..952: note = Synthetic polypeptide
  source 1..952: mol_type = other DNA

SEQ ID NO: 13297 - DNA, 1052 bp, synthetic construct
  misc_feature 1..1052: note = Synthetic polypeptide
  source 1..1052: mol_type = other DNA
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 13298 - DNA, 483 bp, synthetic construct
  misc_feature 1..483: note = Synthetic polypeptide
  source 1..483: mol_type = other DNA
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgg

SEQ ID NO: 13299 - DNA, 402 bp, synthetic construct
  misc_feature 1..402: note = Synthetic polypeptide
  source 1..402: mol_type = other DNA
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcag

SEQ ID NO: 13300 - DNA, 230 bp, synthetic construct
  misc_feature 1..230: note = Synthetic polypeptide
  source 1..230: mol_type = other DNA
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgca

SEQ ID NO: 13301 - DNA, 866 bp, synthetic construct
  misc_feature 1..866: note = Synthetic polypeptide
  source 1..866: mol_type = other DNA
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 13302 - DNA, 1024 bp, synthetic construct; identical to SEQ ID NO: 794
  misc_feature 1..1024: note = Synthetic polypeptide
  source 1..1024: mol_type = other DNA

SEQ ID NO: 13303 - DNA, 1323 bp, synthetic construct
  misc_feature 1..1323: note = Synthetic polypeptide
  source 1..1323: mol_type = other DNA
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaa

SEQ ID NO: 13304 - DNA, 1470 bp, synthetic construct
  misc_feature 1..1470: note = Synthetic polypeptide
  source 1..1470: mol_type = other DNA
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaa

SEQ ID NO: 13305 - DNA, 691 bp, synthetic construct
  misc_feature 1..691: note = Synthetic polypeptide
  source 1..691: mol_type = other DNA
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaagctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagt

SEQ ID NO: 13306 - DNA, 1752 bp, synthetic construct
  misc_feature 1..1752: note = Synthetic polypeptide
  source 1..1752: mol_type = other DNA
ggccagtcacggtggctcacgcctgtaatcccagcactttgggaggctgaggcgggtggatcacttgagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13307 - DNA, 1872 bp, synthetic construct
  misc_feature 1..1872: note = Synthetic polypeptide
  source 1..1872: mol_type = other DNA
ggccagtcacggtggctcacgcctgtaatcccagcactttgggaggctgaggcgggtggatcacttgagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13308 - DNA, 311 bp, synthetic construct
  misc_feature 1..311: note = Synthetic polypeptide
  source 1..311: mol_type = other DNA
ggccgggtgtggtggttcatgcctctcatcccagcacttcaggaggctgaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 13309 - DNA, 370 bp, synthetic construct
  misc_feature 1..370: note = Synthetic polypeptide
  source 1..370: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13310 - DNA, 361 bp, synthetic construct
  misc_feature 1..361: note = Synthetic polypeptide
  source 1..361: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13311 - DNA, 2405 bp, synthetic construct; identical to SEQ ID NO: 8354
  misc_feature 1..2405: note = Synthetic polypeptide
  source 1..2405: mol_type = other DNA

SEQ ID NO: 13312 - DNA, 2252 bp, synthetic construct; identical to SEQ ID NO: 8355
  misc_feature 1..2252: note = Synthetic polypeptide
  source 1..2252: mol_type = other DNA

SEQ ID NO: 13313 - DNA, 2240 bp, synthetic construct; identical to SEQ ID NO: 8356
  misc_feature 1..2240: note = Synthetic polypeptide
  source 1..2240: mol_type = other DNA

SEQ ID NO: 13314 - DNA, 183 bp, synthetic construct
  misc_feature 1..183: note = Synthetic polypeptide
  source 1..183: mol_type = other DNA
ggccgggcacggtggctcacgcttgtaatcccagcactttgggagtccaagggccccaactttgagttctccacggagacccatgaggagctgctgtacaacaaggagaagttgctcaacaacggggacaagtgggaggccgagatcgccgccaacatccaggctgactacttgtatcggtga

SEQ ID NO: 13315 - DNA, 104 bp, synthetic construct
  misc_feature 1..104: note = Synthetic polypeptide
  source 1..104: mol_type = other DNA
ggccgggcacggtggctcacgcttgtaatcccagcactttgggagtccaagggccccaactttgagttctccacggagacccatgaggagctgctgtacaacaa

SEQ ID NO: 13316 - DNA, 491 bp, synthetic construct
  misc_feature 1..491: note = Synthetic polypeptide
  source 1..491: mol_type = other DNA
gcagtggctcaagcctgtaattccagcgctttgggaggccgaggtgggaagacagcttgaggccaggagttggggaccagcctgggcaatatagcgagaccctatctctacaaaaaataaataacaaaaaatactagccaggcgtggtggcacacacctgtagtcctggctgcttggaaggctgaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctga

SEQ ID NO: 13317 - DNA, 213 bp, synthetic construct
  misc_feature 1..213: note = Synthetic polypeptide
  source 1..213: mol_type = other DNA
gcagtggctcaagcctgtaattccagcgctttgggaggccgaggtgggaagacagcttgaggccaggagttggggaccagcctgggcaatatagcgagaccctatctctacaaaaaataaataacaaaaaatactagccaggcgtggtggcacacacctgtagtcctggctgcttggaaggctgaggggtgctggcactgtgggtcctggtga

SEQ ID NO: 13318 - DNA, 198 bp, synthetic construct
  misc_feature 1..198: note = Synthetic polypeptide
  source 1..198: mol_type = other DNA
ggctgggcatggtggcgcacgcctgtaatcccggcacgttgggaggccgaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatgg

SEQ ID NO: 13319 - DNA, 1016 bp, synthetic construct; identical to SEQ ID NO: 6795
  misc_feature 1..1016: note = Synthetic polypeptide
  source 1..1016: mol_type = other DNA

SEQ ID NO: 13320 - DNA, 1187 bp, synthetic construct; identical to SEQ ID NO: 6796
  misc_feature 1..1187: note = Synthetic polypeptide
  source 1..1187: mol_type = other DNA

SEQ ID NO: 13321 - DNA, 965 bp, synthetic construct; identical to SEQ ID NO: 6797
  misc_feature 1..965: note = Synthetic polypeptide
  source 1..965: mol_type = other DNA

SEQ ID NO: 13322 - DNA, 306 bp, synthetic construct
  misc_feature 1..306: note = Synthetic polypeptide
  source 1..306: mol_type = other DNA
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtag

SEQ ID NO: 13323 - DNA, 336 bp, synthetic construct
  misc_feature 1..336: note = Synthetic polypeptide
  source 1..336: mol_type = other DNA
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtgagggcggggcctggaggggcagacggggtggccataaaagacaagcaggaaggaattgagtag

SEQ ID NO: 13324 - DNA, 625 bp, synthetic construct; identical to SEQ ID NO: 6804
  misc_feature 1..625: note = Synthetic polypeptide
  source 1..625: mol_type = other DNA

SEQ ID NO: 13325 - DNA, 598 bp, synthetic construct; identical to SEQ ID NO: 6805
  misc_feature 1..598: note = Synthetic polypeptide
  source 1..598: mol_type = other DNA

SEQ ID NO: 13326 - DNA, 586 bp, synthetic construct; identical to SEQ ID NO: 6809
  misc_feature 1..586: note = Synthetic polypeptide
  source 1..586: mol_type = other DNA

SEQ ID NO: 13327 - DNA, 1243 bp, synthetic construct
  misc_feature 1..1243: note = Synthetic polypeptide
  source 1..1243: mol_type = other DNA
ccccactgggtctgtctctgcatctgtgaaatggctgagtgtgaccaaatgatgcagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctag

SEQ ID NO: 13328 - DNA, 1618 bp, synthetic construct
  misc_feature 1..1618: note = Synthetic polypeptide
  source 1..1618: mol_type = other DNA
ccccactgggtctgtctctgcatctgtgaaatggctgagtgtgaccaaatgatgcagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctga

SEQ ID NO: 13329 - DNA, 1002 bp, synthetic construct
  misc_feature 1..1002: note = Synthetic polypeptide
  source 1..1002: mol_type = other DNA
tcggcttcctgtgtaaagtgagactgatttcccgctctgctcagcccaggccacaggtttttgcgaggatccgttgagatgaacctgaaggctctccggaaattgcgctaggttacaggagtgtaagatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactga

SEQ ID NO: 13330 - DNA, 654 bp, synthetic construct; identical to SEQ ID NO: 6998
  misc_feature 1..654: note = Synthetic polypeptide
  source 1..654: mol_type = other DNA

SEQ ID NO: 13331 - DNA, 651 bp, synthetic construct; identical to SEQ ID NO: 6999
  misc_feature 1..651: note = Synthetic polypeptide
  source 1..651: mol_type = other DNA

SEQ ID NO: 13332 - DNA, 498 bp, synthetic construct; identical to SEQ ID NO: 7000
  misc_feature 1..498: note = Synthetic polypeptide
  source 1..498: mol_type = other DNA

SEQ ID NO: 13333 - DNA, 189 bp, synthetic construct; identical to SEQ ID NO: 7001
  misc_feature 1..189: note = Synthetic polypeptide
  source 1..189: mol_type = other DNA

SEQ ID NO: 13334 - DNA, 1421 bp, synthetic construct
  misc_feature 1..1421: note = Synthetic polypeptide
  source 1..1421: mol_type = other DNA
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13335 - DNA, 1277 bp, synthetic construct
  misc_feature 1..1277: note = Synthetic polypeptide
  source 1..1277: mol_type = other DNA
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13336 - DNA, 226 bp, synthetic construct
  misc_feature 1..226: note = Synthetic polypeptide
  source 1..226: mol_type = other DNA
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacat

SEQ ID NO: 13337 - DNA, 248 bp, synthetic construct
  misc_feature 1..248: note = Synthetic polypeptide
  source 1..248: mol_type = other DNA
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 13338 - DNA, 381 bp, synthetic construct
  misc_feature 1..381: note = Synthetic polypeptide
  source 1..381: mol_type = other DNA
ggcagagcgccgtggcttaggcctgtaatcccagcacggggaggtggaggcgggtggatcactgtagagaccagcctgggcaacatgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 13339 - DNA, 360 bp, synthetic construct
  misc_feature 1..360: note = Synthetic polypeptide
  source 1..360: mol_type = other DNA
ggcagagcgccgtggcttaggcctgtaatcccagcacggggaggtggaggcgggtggatcactgtagagaccagcctgggcaacatgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 13340 - DNA, 2300 bp, synthetic construct
  misc_feature 1..2300: note = Synthetic polypeptide
  source 1..2300: mol_type = other DNA
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagaggtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtga

SEQ ID NO: 13341 - DNA, 2444 bp, synthetic construct
  misc_feature 1..2444: note = Synthetic polypeptide
  source 1..2444: mol_type = other DNA
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtga

SEQ ID NO: 13342 - DNA, 599 bp, synthetic construct
  misc_feature 1..599: note = Synthetic polypeptide
  source 1..599: mol_type = other DNA
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagctgcacagatga

SEQ ID NO: 13343 - DNA, 644 bp, synthetic construct; identical to SEQ ID NO: 7217
  misc_feature 1..644: note = Synthetic polypeptide
  source 1..644: mol_type = other DNA

SEQ ID NO: 13344 - DNA, 518 bp, synthetic construct
  misc_feature 1..518: note = Synthetic polypeptide
  source 1..518: mol_type = other DNA
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaa

SEQ ID NO: 13345 - DNA, 413 bp, synthetic construct
  misc_feature 1..413: note = Synthetic polypeptide
  source 1..413: mol_type = other DNA
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggtaggtgtcatctttcagcagatggggattctgtaa

SEQ ID NO: 13346 - DNA, 296 bp, synthetic construct
  misc_feature 1..296: note = Synthetic polypeptide
  source 1..296: mol_type = other DNA
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttag

SEQ ID NO: 13347 - DNA, 585 bp, synthetic construct
  misc_feature 1..585: note = Synthetic polypeptide
  source 1..585: mol_type = other DNA
tgggcaaaggacttgtggagttcaaagacgtacaagtgatcaacaaacacatggaaagttctcaacatcattagtcattaaagaaatgcacataaaaaaccacaatgaggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctga

SEQ ID NO: 13348 - DNA, 1011 bp, synthetic construct
  misc_feature 1..1011: note = Synthetic polypeptide
  source 1..1011: mol_type = other DNA
tatggatttcctactaatcagcaatagagaaaacttctactccaggctgttgccaggactgtagtctcagacagttgtagcccaattcctacccaactttttattggaagaaataataacatttatgggaaataactcaaaggatatggagttcattagtttttccagaaattctaacttttatccctggatcaggccagataatcagatttttatgtttttttttccttgccagatcactttagtgtgttgtactttggtgtcgtatttcatgttgtgggatgcagtaagaagacattataggagactccctactgtgtatacttagagacattgttaattaattactctcctcttcctccccaaatgtggatgataaaggatcctttgaggctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtga

SEQ ID NO: 13349 - DNA, 612 bp, synthetic construct
  misc_feature 1..612: note = Synthetic polypeptide
  source 1..612: mol_type = other DNA
tatggatttcctactaatcagcaatagagaaaacttctactccaggctgttgccaggactgtagtctcagacagttgtagcccaattcctacccaactttttattggaagaaataataacatttatgggaaataactcaaaggatatggagttcattagtttttccagaaattctaacttttatccctggatcaggccagataatcagatttttatgtttttttttccttgccagatcactttagtgtgttgtactttggtgtcgtatttcatgttgtgggatgcagtaagaagacattataggagactccctactgtgtatacttagagacattgttaattaattactctcctcttcctccccaaatgtggatgataaaggatcctttgaggctgattactctgagtgcaaaccttttcactgttccagagaggagcctgacaaccacattctccttctcaagatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctga

SEQ ID NO: 13350 - DNA, 618 bp, synthetic construct
  misc_feature 1..618: note = Synthetic polypeptide
  source 1..618: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13351 - DNA, 501 bp, synthetic construct
  misc_feature 1..501: note = Synthetic polypeptide
  source 1..501: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13352 - DNA, 405 bp, synthetic construct
  misc_feature 1..405: note = Synthetic polypeptide
  source 1..405: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaaggtaccctga

SEQ ID NO: 13353 - DNA, 297 bp, synthetic construct
  misc_feature 1..297: note = Synthetic polypeptide
  source 1..297: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctga

SEQ ID NO: 13354 - DNA, 567 bp, synthetic construct
  misc_feature 1..567: note = Synthetic polypeptide
  source 1..567: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13355 - DNA, 450 bp, synthetic construct
  misc_feature 1..450: note = Synthetic polypeptide
  source 1..450: mol_type = other DNA
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagacactggtggtcagagaacagactgagcggtggagtgagttgggacgggagtga

SEQ ID NO: 13356 - DNA, 493 bp, synthetic construct
  misc_feature 1..493: note = Synthetic polypeptide
  source 1..493: mol_type = other DNA
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacaca

SEQ ID NO: 13357 - DNA, 1186 bp, synthetic construct
  misc_feature 1..1186: note = Synthetic polypeptide
  source 1..1186: mol_type = other DNA
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctga

SEQ ID NO: 13358 - DNA, 1021 bp, synthetic construct
  misc_feature 1..1021: note = Synthetic polypeptide
  source 1..1021: mol_type = other DNA
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctga

SEQ ID NO: 13359 - DNA, 926 bp, synthetic construct; identical to SEQ ID NO: 8671
  misc_feature 1..926: note = Synthetic polypeptide
  source 1..926: mol_type = other DNA

SEQ ID NO: 13360 - DNA, 890 bp, synthetic construct; identical to SEQ ID NO: 8672
  misc_feature 1..890: note = Synthetic polypeptide
  source 1..890: mol_type = other DNA

SEQ ID NO: 13361 - DNA, 878 bp, synthetic construct; identical to SEQ ID NO: 8673
  misc_feature 1..878: note = Synthetic polypeptide
  source 1..878: mol_type = other DNA

SEQ ID NO: 13362 - DNA, 2231 bp, synthetic construct; identical to SEQ ID NO: 9963
  misc_feature 1..2231: note = Synthetic polypeptide
  source 1..2231: mol_type = other DNA

SEQ ID NO: 13363 - DNA, 650 bp, synthetic construct; identical to SEQ ID NO: 9089
  misc_feature 1..650: note = Synthetic polypeptide
  source 1..650: mol_type = other DNA

SEQ ID NO: 13364 - DNA, 1052 bp, synthetic construct; identical to SEQ ID NO: 9090
  misc_feature 1..1052: note = Synthetic polypeptide
  source 1..1052: mol_type = other DNA

SEQ ID NO: 13365 - DNA, 419 bp, synthetic construct
  misc_feature 1..419: note = Synthetic polypeptide
  source 1..419: mol_type = other DNA
acagctgtttgtttttctgaccaacattgttcctccacctcccacccaagagaagcactgttttctttatggtgggaattactcctcctcaaccttttgggtcctggtggggctgcaaatcatagtaccctgtctcttctgggaagagcaccttctgatagggtgatcacagtgtcccgtggcctgtcacatacttgtgtatgtggcccaagctgggccagtcaccatttcctgggagttaatttaggaaccctgagagacagacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 13366 - DNA, 1325 bp, synthetic construct
  misc_feature 1..1325: note = Synthetic polypeptide
  source 1..1325: mol_type = other DNA
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaacccctttttaa

SEQ ID NO: 13367 - DNA, 776 bp, synthetic construct
  misc_feature 1..776: note = Synthetic polypeptide
  source 1..776: mol_type = other DNA
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccagtaagtaactga

SEQ ID NO: 13368 - DNA, 467 bp, synthetic construct
  misc_feature 1..467: note = Synthetic polypeptide
  source 1..467: mol_type = other DNA
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgctggaagatggagctggtga

SEQ ID NO: 13369 - DNA, 1470 bp, synthetic construct
  misc_feature 1..1470: note = Synthetic polypeptide
  source 1..1470: mol_type = other DNA
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtga

SEQ ID NO: 13370 - DNA, 354 bp, synthetic construct
  misc_feature 1..354: note = Synthetic polypeptide
  source 1..354: mol_type = other DNA
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcccaaacttga

SEQ ID NO: 13371 - DNA, 696 bp, synthetic construct
  misc_feature 1..696: note = Synthetic polypeptide
  source 1..696: mol_type = other DNA
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttga

SEQ ID NO: 13372 - DNA, 432 bp, synthetic construct
  misc_feature 1..432: note = Synthetic polypeptide
  source 1..432: mol_type = other DNA
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactga

SEQ ID NO: 13373 - DNA, 303 bp, synthetic construct
  misc_feature 1..303: note = Synthetic polypeptide
  source 1..303: mol_type = other DNA
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 13374 - DNA, 306 bp, synthetic construct
  misc_feature 1..306: note = Synthetic polypeptide
  source 1..306: mol_type = other DNA
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 13375 - DNA, 778 bp, synthetic construct
  misc_feature 1..778: note = Synthetic polypeptide
  source 1..778: mol_type = other DNA
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 13376 - DNA, 499 bp, synthetic construct
  misc_feature 1..499: note = Synthetic polypeptide
  source 1..499: mol_type = other DNA
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 13377 - DNA, 186 bp, synthetic construct
  misc_feature 1..186: note = Synthetic polypeptide
  source 1..186: mol_type = other DNA
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatga

SEQ ID NO: 13378 - DNA, 186 bp, synthetic construct
  misc_feature 1..186: note = Synthetic polypeptide
  source 1..186: mol_type = other DNA
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtga

SEQ ID NO: 13379 - DNA, 177 bp, synthetic construct
  misc_feature 1..177: note = Synthetic polypeptide
  source 1..177: mol_type = other DNA
gccaggatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctag

SEQ ID NO: 13380 - DNA, 327 bp, synthetic construct
  misc_feature 1..327: note = Synthetic polypeptide
  source 1..327: mol_type = other DNA
ggccgggcgcggtggctcactcctgtaatcccagcactttgggaggccaagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 13381 - DNA, 805 bp, synthetic construct
  misc_feature 1..805: note = Synthetic polypeptide
  source 1..805: mol_type = other DNA
ctgttaaggcatcatttctatgtgccatggctcactgctattactcgagccatttgtaaacaaatggtgttaaattcgtgctcagaacaatgcatgacaagggcctactcggcccccaggagttcaggaaacaggagccaggcagccataccctgtgaaaaactgtggtacggacttcgaggaagtaccctgagaggggggttatcagtgcacgtgggtgttcatttgcaccttttcaggaggttgaggccttccccacccggacagagaaggcactagaagtaaccaaggtgttgttaagagacattattcccagatttggactgcctctaactctaagatcagacaatagcccaatatttatggctgaaatagttcaggacttaacttgattattaaaaataaagtggaaattacatacagcttacaggctgcagagctcagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 13382 - DNA, 375 bp, synthetic construct; identical to SEQ ID NO: 860
  misc_feature 1..375: note = Synthetic polypeptide
  source 1..375: mol_type = other DNA

SEQ ID NO: 13383 - DNA, 255 bp, synthetic construct; identical to SEQ ID NO: 862
  misc_feature 1..255: note = Synthetic polypeptide
  source 1..255: mol_type = other DNA

SEQ ID NO: 13384 - DNA, 519 bp, synthetic construct; identical to SEQ ID NO: 9679
  misc_feature 1..519: note = Synthetic polypeptide
  source 1..519: mol_type = other DNA

SEQ ID NO: 13385 - DNA, 213 bp, synthetic construct; identical to SEQ ID NO: 9680
  misc_feature 1..213: note = Synthetic polypeptide
  source 1..213: mol_type = other DNA

SEQ ID NO: 13386 - DNA, 3621 bp, synthetic construct; identical to SEQ ID NO: 8171
  misc_feature 1..3621: note = Synthetic polypeptide
  source 1..3621: mol_type = other DNA

SEQ ID NO: 13387 - DNA, 3312 bp, synthetic construct; identical to SEQ ID NO: 8172
  misc_feature 1..3312: note = Synthetic polypeptide
  source 1..3312: mol_type = other DNA

SEQ ID NO: 13388 - DNA, 2928 bp, synthetic construct; identical to SEQ ID NO: 8173
  misc_feature 1..2928: note = Synthetic polypeptide
  source 1..2928: mol_type = other DNA

SEQ ID NO: 13389 - DNA, 3435 bp, synthetic construct; identical to SEQ ID NO: 8174
  misc_feature 1..3435: note = Synthetic polypeptide
  source 1..3435: mol_type = other DNA

SEQ ID NO: 13390 - DNA, 1331 bp, synthetic construct; identical to SEQ ID NO: 550
  misc_feature 1..1331: note = Synthetic polypeptide
  source 1..1331: mol_type = other DNA

SEQ ID NO: 13391 - DNA, 1028 bp, synthetic construct; identical to SEQ ID NO: 551
  misc_feature 1..1028: note = Synthetic polypeptide
  source 1..1028: mol_type = other DNA

SEQ ID NO: 13392 - DNA, 1295 bp, synthetic construct; identical to SEQ ID NO: 553
  misc_feature 1..1295: note = Synthetic polypeptide
  source 1..1295: mol_type = other DNA

SEQ ID NO: 13393 - DNA, 1322 bp, synthetic construct; identical to SEQ ID NO: 554
  misc_feature 1..1322: note = Synthetic polypeptide
  source 1..1322: mol_type = other DNA

SEQ ID NO: 13394 - DNA, 1013 bp, synthetic construct; identical to SEQ ID NO: 555
  misc_feature 1..1013: note = Synthetic polypeptide
  source 1..1013: mol_type = other DNA

SEQ ID NO: 13395 - DNA, 1584 bp, synthetic construct; identical to SEQ ID NO: 8495
  misc_feature 1..1584: note = Synthetic polypeptide
  source 1..1584: mol_type = other DNA

SEQ ID NO: 13396 - DNA, 1242 bp, synthetic construct; identical to SEQ ID NO: 8496
  misc_feature 1..1242: note = Synthetic polypeptide
  source 1..1242: mol_type = other DNA

SEQ ID NO: 13397 - DNA, 1539 bp, synthetic construct; identical to SEQ ID NO: 8497
  misc_feature 1..1539: note = Synthetic polypeptide
  source 1..1539: mol_type = other DNA

SEQ ID NO: 13398 - DNA, 1623 bp, synthetic construct; identical to SEQ ID NO: 8498
  misc_feature 1..1623: note = Synthetic polypeptide
  source 1..1623: mol_type = other DNA

SEQ ID NO: 13399 - DNA, 1677 bp, synthetic construct; identical to SEQ ID NO: 8499
  misc_feature 1..1677: note = Synthetic polypeptide
  source 1..1677: mol_type = other DNA

SEQ ID NO: 13400 - DNA, 1632 bp, synthetic construct; identical to SEQ ID NO: 8500
  misc_feature 1..1632: note = Synthetic polypeptide
  source 1..1632: mol_type = other DNA

SEQ ID NO: 13401 - DNA, 555 bp, synthetic construct; identical to SEQ ID NO: 8501
  misc_feature 1..555: note = Synthetic polypeptide
  source 1..555: mol_type = other DNA

SEQ ID NO: 13402 - DNA, 401 bp, synthetic construct; identical to SEQ ID NO: 8502
  misc_feature 1..401: note = Synthetic polypeptide
  source 1..401: mol_type = other DNA

SEQ ID NO: 13403 - DNA, 166 bp, synthetic construct; identical to SEQ ID NO: 8503
  misc_feature 1..166: note = Synthetic polypeptide
  source 1..166: mol_type = other DNA

SEQ ID NO: 13404 - DNA, 184 bp, synthetic construct
  misc_feature 1..184: note = Synthetic polypeptide
  source 1..184: mol_type = other DNA
ggggaggagccaagatggccgaataggaacagctccggtctacagctcccagcgtgagcgacacagaagacgggtgatttctgcatttccatctgaggaatgggaagatacagtgcagtcggaagtgttactgagagaattttcacattatactatgatcacttgggattcctacataagctga

SEQ ID NO: 13405 - DNA, 2016 bp, synthetic construct
  misc_feature 1..2016: note = Synthetic polypeptide
  source 1..2016: mol_type = other DNA
ggggaggagccaagatggccgaataggaacagctccggtctacagctcccagcgtgagcgacacagaagacgggtgatttctgcatttccatctgaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtga

SEQ ID NO: 13406 - DNA, 162 bp, synthetic construct
  misc_feature 1..162: note = Synthetic polypeptide
  source 1..162: mol_type = other DNA
gggcatgatggttcacacctgtaatcccagcactttggaaagtcgaggcaggtggatcatttgaggtcaggagtttgagaccagcctggccaacatggatttaagaggggtgcagatcccggaatgcctgaaccaactgttttgagcctactttggggataa

SEQ ID NO: 13407 - DNA, 372 bp, synthetic construct
  misc_feature 1..372: note = Synthetic polypeptide
  source 1..372: mol_type = other DNA
gggcatgatggttcacacctgtaatcccagcactttggaaagtcgaggcaggtggatcatttgaggtcaggagtttgagaccagcctggccaacatggatttaagaggggtgcagatcccggaatgcctgaaccaactgttttgagggtgtggtggctcacacctgtaatctcagcactttggaaagccaaggtgggaagatcatgggaggattgcttgaagctaggagttcaagaccagcctgggcaacgtagcgagacccatctctaccaaaaaaaaaaaacctactttggggataaaggattatttggtcttctggatttggaggcaatcagcggacagcatggaagatgtgtgctctggctcggataa

SEQ ID NO: 13408 - DNA, 516 bp, synthetic construct
  misc_feature 1..516: note = Synthetic polypeptide
  source 1..516: mol_type = other DNA
gaggagccaagatggccgaataggaacagctccggtctacagctcccagcgtgagcgacgcagaagacgggtgatttctgcatttccatctgagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggtatga

SEQ ID NO: 13409 - DNA, 1083 bp, synthetic construct
  misc_feature 1..1083: note = Synthetic polypeptide
  source 1..1083: mol_type = other DNA
gaggagccaagatggccgaataggaacagctccggtctacagctcccagcgtgagcgacgcagaagacgggtgatttctgcatttccatctgagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtga

SEQ ID NO: 13410 - DNA, 1090 bp, synthetic construct
  misc_feature 1..1090: note = Synthetic polypeptide
  source 1..1090: mol_type = other DNA
gagtgtgggcgcgaggcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 13411 - DNA, 1151 bp, synthetic construct
  misc_feature 1..1151: note = Synthetic polypeptide
  source 1..1151: mol_type = other DNA
ggtgggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtga

SEQ ID NO: 13412 - DNA, 373 bp, synthetic construct
  misc_feature 1..373: note = Synthetic polypeptide
  source 1..373: mol_type = other DNA
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactag

SEQ ID NO: 13413 - DNA, 88 bp, synthetic construct
  misc_feature 1..88: note = Synthetic polypeptide
  source 1..88: mol_type = other DNA
gcgcgcggcggcccctgataaggtgaagaagggcggcccggggagcgagtgcgctgagtgggcctgggggccctgcacccccagcagc

SEQ ID NO: 13414 - DNA, 335 bp, synthetic construct
  misc_feature 1..335: note = Synthetic polypeptide
  source 1..335: mol_type = other DNA
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaag

SEQ ID NO: 13415 - DNA, 412 bp, synthetic construct
  misc_feature 1..412: note = Synthetic polypeptide
  source 1..412: mol_type = other DNA
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccccgcctgtga

SEQ ID NO: 13416 - DNA, 1319 bp, synthetic construct
  misc_feature 1..1319: note = Synthetic polypeptide
  source 1..1319: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 13417 - DNA, 1685 bp, synthetic construct
  misc_feature 1..1685: note = Synthetic polypeptide
  source 1..1685: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 13418 - DNA, 1535 bp, synthetic construct
  misc_feature 1..1535: note = Synthetic polypeptide
  source 1..1535: mol_type = other DNA
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 13419 - DNA, 637 bp, synthetic construct; identical to SEQ ID NO: 11967
  misc_feature 1..637: note = Synthetic polypeptide
  source 1..637: mol_type = other DNA

SEQ ID NO: 13420 - DNA, 2521 bp, synthetic construct; identical to SEQ ID NO: 11968
  misc_feature 1..2521: note = Synthetic polypeptide
  source 1..2521: mol_type = other DNA

SEQ ID NO: 13421 - DNA, 398 bp, synthetic construct; identical to SEQ ID NO: 6790
  misc_feature 1..398: note = Synthetic polypeptide
  source 1..398: mol_type = other DNA

SEQ ID NO: 13422 - DNA, 391 bp, synthetic construct; identical to SEQ ID NO: 6791
  misc_feature 1..391: note = Synthetic polypeptide
  source 1..391: mol_type = other DNA

SEQ ID NO: 13423 - DNA, 473 bp, synthetic construct; identical to SEQ ID NO: 6792
  misc_feature 1..473: note = Synthetic polypeptide
  source 1..473: mol_type = other DNA

SEQ ID NO: 13424 - DNA, 756 bp, synthetic construct
  misc_feature 1..756: note = Synthetic polypeptide
  source 1..756: mol_type = other DNA
gtggagcctttaaaaggtgattgagtcatgaaggctctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatgggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 13425 - DNA, 477 bp, synthetic construct; identical to SEQ ID NO: 8538
  misc_feature 1..477: note = Synthetic polypeptide
  source 1..477: mol_type = other DNA

SEQ ID NO: 13426 - DNA, 820 bp, synthetic construct
  misc_feature 1..820: note = Synthetic polypeptide
  source 1..820: mol_type = other DNA
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatag

SEQ ID NO: 13427 - DNA, 420 bp, synthetic construct
  misc_feature 1..420: note = Synthetic polypeptide
  source 1..420: mol_type = other DNA
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccagctttgcacacgccgcttcctctgcctggggcactttttctctcctttttgtagctcattctccgtcctccgtcagatgtcaccttcacccttccctacccctcctcttctgggcccacaaccctagtgcagccct

SEQ ID NO: 13428 - DNA, 700 bp, synthetic construct
  misc_feature 1..700: note = Synthetic polypeptide
  source 1..700: mol_type = other DNA
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatag

SEQ ID NO: 13429 - DNA, 820 bp, synthetic construct
  misc_feature 1..820: note = Synthetic polypeptide
  source 1..820: mol_type = other DNA
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggcaggtctgcccagctcccggaacactctgaaagccgcacgccaaacccatatcaggtgcctggagtctggaggttttggctgcagccccaggaccagccttgccctgcgcctcacctga

SEQ ID NO: 13430 - DNA, 598 bp, synthetic construct
  misc_feature 1..598: note = Synthetic polypeptide
  source 1..598: mol_type = other DNA
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctga

SEQ ID NO: 13431 - DNA, 711 bp, synthetic construct; identical to SEQ ID NO: 7220
  misc_feature 1..711: note = Synthetic polypeptide
  source 1..711: mol_type = other DNA

SEQ ID NO: 13432 - DNA, 447 bp, synthetic construct; identical to SEQ ID NO: 7221
  misc_feature 1..447: note = Synthetic polypeptide
  source 1..447: mol_type = other DNA

SEQ ID NO: 13433 - DNA, 1530 bp, synthetic construct; identical to SEQ ID NO: 7222
  misc_feature 1..1530: note = Synthetic polypeptide
  source 1..1530: mol_type = other DNA

SEQ ID NO: 13434 - DNA, 747 bp, synthetic construct
  misc_feature 1..747: note = Synthetic polypeptide
  source 1..747: mol_type = other DNA
cctccagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatga

SEQ ID NO: 13435 - DNA, 735 bp, synthetic construct
  misc_feature 1..735: note = Synthetic polypeptide
  source 1..735: mol_type = other DNA
cctccagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtag

SEQ ID NO: 13436 - DNA, 470 bp, synthetic construct; identical to SEQ ID NO: 9114
  misc_feature 1..470: note = Synthetic polypeptide
  source 1..470: mol_type = other DNA

SEQ ID NO: 13437 - DNA, 134 bp, synthetic construct; identical to SEQ ID NO: 9115
  misc_feature 1..134: note = Synthetic polypeptide
  source 1..134: mol_type = other DNA

SEQ ID NO: 13438 - DNA, 6216 bp, synthetic construct
  misc_feature 1..6216: note = Synthetic polypeptide
  source 1..6216: mol_type = other DNA
ctgggtgcagtggctcatgcctgtaatcccaccactttaggaggccgaggcagcctgatggcttgagctcaggagtttgagaccagcctgggcaacatgtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggctattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctga

SEQ ID NO: 13439 - DNA, 1317 bp, synthetic construct; identical to SEQ ID NO: 7058
  misc_feature 1..1317: note = Synthetic polypeptide
  source 1..1317: mol_type = other DNA

SEQ ID NO: 13440 - DNA, 217 bp, synthetic construct
  misc_feature 1..217: note = Synthetic polypeptide
  source 1..217: mol_type = other DNA
ggccgggtgtggtggctcacacccgtaatcccaagactttaggaggctgagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 13441 - DNA, 440 bp, synthetic construct
  misc_feature 1..440: note = Synthetic polypeptide
  source 1..440: mol_type = other DNA
ggccgggtgtggtggctcacacccgtaatcccaagactttaggaggctgagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 13442 - DNA, 298 bp, synthetic construct
  misc_feature 1..298: note = Synthetic polypeptide
  source 1..298: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagatgaggaagctgagtcagctacgggcaagcgggcagctgaagatgatgaggatgacgatgtcgataccaagaagcagaagaccgacgaggatgactag

SEQ ID NO: 13443 - DNA, 952 bp, synthetic construct; identical to SEQ ID NO: 6966
  misc_feature 1..952: note = Synthetic polypeptide
  source 1..952: mol_type = other DNA

SEQ ID NO: 13444 - DNA, 754 bp, synthetic construct; identical to SEQ ID NO: 6967
  misc_feature 1..754: note = Synthetic polypeptide
  source 1..754: mol_type = other DNA

SEQ ID NO: 13445 - DNA, 450 bp, synthetic construct; identical to SEQ ID NO: 6968
  misc_feature 1..450: note = Synthetic polypeptide
  source 1..450: mol_type = other DNA

SEQ ID NO: 13446 - DNA, 1484 bp, synthetic construct
  misc_feature 1..1484: note = Synthetic polypeptide
  source 1..1484: mol_type = other DNA
ggccgagtgggagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctag

SEQ ID NO: 13447 - DNA, 316 bp, synthetic construct; identical to SEQ ID NO: 8692
  misc_feature 1..316: note = Synthetic polypeptide
  source 1..316: mol_type = other DNA

SEQ ID NO: 13448 - DNA, 1265 bp, synthetic construct
  misc_feature 1..1265: note = Synthetic polypeptide
  source 1..1265: mol_type = other DNA
ggaagcagacagacaggaagggaaaacacaatgcaacagaaggagagattgaagtgttggcagctgcaagccaagaaacacctgggttaccagaagctagaagaagaaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctga

SEQ ID NO: 13449 - DNA, 1154 bp, synthetic construct
  misc_feature 1..1154: note = Synthetic polypeptide
  source 1..1154: mol_type = other DNA
ggaagcagacagacaggaagggaaaacacaatgcaacagaaggagagattgaagtgttggcagctgcaagccaagaaacacctgggttaccagaagctagaagaagaaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctga

SEQ ID NO: 13450 - DNA, 2619 bp, synthetic construct
  misc_feature 1..2619: note = Synthetic polypeptide
  source 1..2619: mol_type = other DNA
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactga

SEQ ID NO: 13451 - DNA, 840 bp, synthetic construct
  misc_feature 1..840: note = Synthetic polypeptide
  source 1..840: mol_type = other DNA
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctga

SEQ ID NO: 13452 - DNA, 543 bp, synthetic construct
  misc_feature 1..543: note = Synthetic polypeptide
  source 1..543: mol_type = other DNA
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacattga

SEQ ID NO: 13453 - DNA, 781 bp, synthetic construct
  misc_feature 1..781: note = Synthetic polypeptide
  source 1..781: mol_type = other DNA
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccag

SEQ ID NO: 13454 - DNA, 363 bp, synthetic construct
  misc_feature 1..363: note = Synthetic polypeptide
  source 1..363: mol_type = other DNA
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagtttcagcgtga

SEQ ID NO: 13455 - DNA, 4908 bp, synthetic construct; identical to SEQ ID NO: 11516
  misc_feature 1..4908: note = Synthetic polypeptide
  source 1..4908: mol_type = other DNA

SEQ ID NO: 13456 - DNA, 4611 bp, synthetic construct; identical to SEQ ID NO: 11517
  misc_feature 1..4611: note = Synthetic polypeptide
  source 1..4611: mol_type = other DNA

SEQ ID NO: 13457 - DNA, 5142 bp, synthetic construct; identical to SEQ ID NO: 11518
  misc_feature 1..5142: note = Synthetic polypeptide
  source 1..5142: mol_type = other DNA

SEQ ID NO: 13458 - DNA, 777 bp, synthetic construct; identical to SEQ ID NO: 11519
  misc_feature 1..777: note = Synthetic polypeptide
  source 1..777: mol_type = other DNA

SEQ ID NO: 13459 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13460 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13461 - DNA, 1061 bp, synthetic construct
  misc_feature 1..1061: note = Synthetic polypeptide
  source 1..1061: mol_type = other DNA
ttccccaaacacgcggccctgagcctccggtgctttgcgaaagccgtcccctccggctggaatgttctttgtctctctggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctga

SEQ ID NO: 13462 - DNA, 944 bp, synthetic construct
  misc_feature 1..944: note = Synthetic polypeptide
  source 1..944: mol_type = other DNA
ttccccaaacacgcggccctgagcctccggtgctttgcgaaagccgtcccctccggctggaatgttctttgtctctctggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccagaaaacgctgccgcggtccacagtgtcgattctggatgaccacattagccactatccacagctag

SEQ ID NO: 13463 - DNA, 946 bp, synthetic construct
  misc_feature 1..946: note = Synthetic polypeptide
  source 1..946: mol_type = other DNA
aagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 13464 - DNA, 1003 bp, synthetic construct
  misc_feature 1..1003: note = Synthetic polypeptide
  source 1..1003: mol_type = other DNA
aagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 13465 - DNA, 2738 bp, synthetic construct
  misc_feature 1..2738: note = Synthetic polypeptide
  source 1..2738: mol_type = other DNA
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaa

SEQ ID NO: 13466 - DNA, 629 bp, synthetic construct
  misc_feature 1..629: note = Synthetic polypeptide
  source 1..629: mol_type = other DNA
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctag

SEQ ID NO: 13467 - DNA, 918 bp, synthetic construct
  misc_feature 1..918: note = Synthetic polypeptide
  source 1..918: mol_type = other DNA
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaa

SEQ ID NO: 13468 - DNA, 1151 bp, synthetic construct
  misc_feature 1..1151: note = Synthetic polypeptide
  source 1..1151: mol_type = other DNA
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtga

SEQ ID NO: 13469 - DNA, 516 bp, synthetic construct
  misc_feature 1..516: note = Synthetic polypeptide
  source 1..516: mol_type = other DNA
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 13470 - DNA, 353 bp, synthetic construct
  misc_feature 1..353: note = Synthetic polypeptide
  source 1..353: mol_type = other DNA
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtga

SEQ ID NO: 13471 - DNA, 1679 bp, synthetic construct
  misc_feature 1..1679: note = Synthetic polypeptide
  source 1..1679: mol_type = other DNA
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 13472 - DNA, 1916 bp, synthetic construct
  misc_feature 1..1916: note = Synthetic polypeptide
  source 1..1916: mol_type = other DNA
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 13473 - DNA, 1896 bp, synthetic construct; identical to SEQ ID NO: 8628
  misc_feature 1..1896: note = Synthetic polypeptide
  source 1..1896: mol_type = other DNA

SEQ ID NO: 13474 - DNA, 1803 bp, synthetic construct; identical to SEQ ID NO: 8629
  misc_feature 1..1803: note = Synthetic polypeptide
  source 1..1803: mol_type = other DNA

SEQ ID NO: 13475 - DNA, 1014 bp, synthetic construct; identical to SEQ ID NO: 8630
  misc_feature 1..1014: note = Synthetic polypeptide
  source 1..1014: mol_type = other DNA

SEQ ID NO: 13476 - DNA, 1816 bp, synthetic construct
  misc_feature 1..1816: note = Synthetic polypeptide
  source 1..1816: mol_type = other DNA
ttaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctga

SEQ ID NO: 13477 - DNA, 577 bp, synthetic construct
  misc_feature 1..577: note = Synthetic polypeptide
  source 1..577: mol_type = other DNA
ttaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagagga

SEQ ID NO: 13478 - DNA, 778 bp, synthetic construct
  misc_feature 1..778: note = Synthetic polypeptide
  source 1..778: mol_type = other DNA
tttttttgtttgtttgtttggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtag

SEQ ID NO: 13479 - DNA, 466 bp, synthetic construct; identical to SEQ ID NO: 8369
  misc_feature 1..466: note = Synthetic polypeptide
  source 1..466: mol_type = other DNA

SEQ ID NO: 13480 - DNA, 526 bp, synthetic construct; identical to SEQ ID NO: 8370
  misc_feature 1..526: note = Synthetic polypeptide
  source 1..526: mol_type = other DNA

SEQ ID NO: 13481 - DNA, 319 bp, synthetic construct; identical to SEQ ID NO: 8371
  misc_feature 1..319: note = Synthetic polypeptide
  source 1..319: mol_type = other DNA

SEQ ID NO: 13482 - DNA, 520 bp, synthetic construct; identical to SEQ ID NO: 8372
  misc_feature 1..520: note = Synthetic polypeptide
  source 1..520: mol_type = other DNA

SEQ ID NO: 13483 - DNA, 1346 bp, synthetic construct; identical to SEQ ID NO: 7758
  misc_feature 1..1346: note = Synthetic polypeptide
  source 1..1346: mol_type = other DNA

SEQ ID NO: 13484 - DNA, 902 bp, synthetic construct
  misc_feature 1..902: note = Synthetic polypeptide
  source 1..902: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctga

SEQ ID NO: 13485 - DNA, 266 bp, synthetic construct
  misc_feature 1..266: note = Synthetic polypeptide
  source 1..266: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctga

SEQ ID NO: 13486 - DNA, 591 bp, synthetic construct
  misc_feature 1..591: note = Synthetic polypeptide
  source 1..591: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaac

SEQ ID NO: 13487 - DNA, 612 bp, synthetic construct
  misc_feature 1..612: note = Synthetic polypeptide
  source 1..612: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaaga

SEQ ID NO: 13488 - DNA, 203 bp, synthetic construct
  misc_feature 1..203: note = Synthetic polypeptide
  source 1..203: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgagacagagtttcaccatgttggccaggatggtcttgatctgacctcgtga

SEQ ID NO: 13489 - DNA, 263 bp, synthetic construct
  misc_feature 1..263: note = Synthetic polypeptide
  source 1..263: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaaggtgagggggaaagagaccgaggccttgccaggagtcctagtctgtggattcctgatgagttcgacaatgatccaattctggtacagcagttgcgccggacatacaaatatttcaaagattatagacagatga

SEQ ID NO: 13490 - DNA, 536 bp, synthetic construct
  misc_feature 1..536: note = Synthetic polypeptide
  source 1..536: mol_type = other DNA
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaag

SEQ ID NO: 13491 - DNA, 890 bp, synthetic construct
  misc_feature 1..890: note = Synthetic polypeptide
  source 1..890: mol_type = other DNA
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 13492 - DNA, 467 bp, synthetic construct
  misc_feature 1..467: note = Synthetic polypeptide
  source 1..467: mol_type = other DNA
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctga

SEQ ID NO: 13493 - DNA, 347 bp, synthetic construct
  misc_feature 1..347: note = Synthetic polypeptide
  source 1..347: mol_type = other DNA
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctga

SEQ ID NO: 13494 - DNA, 467 bp, synthetic construct
  misc_feature 1..467: note = Synthetic polypeptide
  source 1..467: mol_type = other DNA
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctga

SEQ ID NO: 13495 - DNA, 941 bp, synthetic construct
  misc_feature 1..941: note = Synthetic polypeptide
  source 1..941: mol_type = other DNA
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 13496 - DNA, 215 bp, synthetic construct
  misc_feature 1..215: note = Synthetic polypeptide
  source 1..215: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaa

SEQ ID NO: 13497 - DNA, 441 bp, synthetic construct
  misc_feature 1..441: note = Synthetic polypeptide
  source 1..441: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13498 - DNA, 444 bp, synthetic construct
  misc_feature 1..444: note = Synthetic polypeptide
  source 1..444: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13499 - DNA, 432 bp, synthetic construct
  misc_feature 1..432: note = Synthetic polypeptide
  source 1..432: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctaatgaggaaaatggggagcaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13500 - DNA, 634 bp, synthetic construct
  misc_feature 1..634: note = Synthetic polypeptide
  source 1..634: mol_type = other DNA
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactga

SEQ ID NO: 13501 - DNA, 367 bp, synthetic construct
  misc_feature 1..367: note = Synthetic polypeptide
  source 1..367: mol_type = other DNA
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttga

SEQ ID NO: 13502 - DNA, 612 bp, synthetic construct
  misc_feature 1..612: note = Synthetic polypeptide
  source 1..612: mol_type = other DNA
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 13503 - DNA, 1446 bp, synthetic construct; identical to SEQ ID NO: 8572
  misc_feature 1..1446: note = Synthetic polypeptide
  source 1..1446: mol_type = other DNA

SEQ ID NO: 13504 - DNA, 104 bp, synthetic construct; identical to SEQ ID NO: 8573
  misc_feature 1..104: note = Synthetic polypeptide
  source 1..104: mol_type = other DNA

SEQ ID NO: 13505 - DNA, 489 bp, synthetic construct; identical to SEQ ID NO: 8574
  misc_feature 1..489: note = Synthetic polypeptide
  source 1..489: mol_type = other DNA

SEQ ID NO: 13506 - DNA, 1196 bp, synthetic construct
  misc_feature 1..1196: note = Synthetic polypeptide
  source 1..1196: mol_type = other DNA
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaa

SEQ ID NO: 13507 - DNA, 794 bp, synthetic construct
  misc_feature 1..794: note = Synthetic polypeptide
  source 1..794: mol_type = other DNA
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctc

SEQ ID NO: 13508 - DNA, 660 bp, synthetic construct
  misc_feature 1..660: note = Synthetic polypeptide
  source 1..660: mol_type = other DNA
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtct

SEQ ID NO: 13509 - DNA, 602 bp, synthetic construct
  misc_feature 1..602: note = Synthetic polypeptide
  source 1..602: mol_type = other DNA
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaag

SEQ ID NO: 13510 - DNA, 311 bp, synthetic construct
  misc_feature 1..311: note = Synthetic polypeptide
  source 1..311: mol_type = other DNA
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtgccatccccctctcccagtgtggtagcctcagccaggtcaggtga

SEQ ID NO: 13511 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13512 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13513 - DNA, 1242 bp, synthetic construct
  misc_feature 1..1242: note = Synthetic polypeptide
  source 1..1242: mol_type = other DNA
ggttgggcacagtggcttatgcttgtaatcccagcactttgggaggtcaaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtag

SEQ ID NO: 13514 - DNA, 950 bp, synthetic construct; identical to SEQ ID NO: 8419
  misc_feature 1..950: note = Synthetic polypeptide
  source 1..950: mol_type = other DNA

SEQ ID NO: 13515 - DNA, 525 bp, synthetic construct
  misc_feature 1..525: note = Synthetic polypeptide
  source 1..525: mol_type = other DNA
gacttgggaatcaggtcccagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatga

SEQ ID NO: 13516 - DNA, 351 bp, synthetic construct
  misc_feature 1..351: note = Synthetic polypeptide
  source 1..351: mol_type = other DNA
gacttgggaatcaggtcccagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggccagcagcaacacccacagcctgtttgagagtggcatcaattggggccgtgtggtggctcttctgggcttcggctaccgtctggccctacacgtctaccagcatggcctga

SEQ ID NO: 13517 - DNA, 533 bp, synthetic construct
  misc_feature 1..533: note = Synthetic polypeptide
  source 1..533: mol_type = other DNA
gtcaggcgtccgggttcgaacccggcccagccccggccttgcagggcaacgtctggccctggcttcctcctttggaaagtggcgttcgcgacggtgccggctcggggttattgctaaattgagcgcgatgattcaggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaa

SEQ ID NO: 13518 - DNA, 2535 bp, synthetic construct; identical to SEQ ID NO: 6677
  misc_feature 1..2535: note = Synthetic polypeptide
  source 1..2535: mol_type = other DNA

SEQ ID NO: 13519 - DNA, 2181 bp, synthetic construct; identical to SEQ ID NO: 6678
  misc_feature 1..2181: note = Synthetic polypeptide
  source 1..2181: mol_type = other DNA

SEQ ID NO: 13520 - DNA, 1119 bp, synthetic construct; identical to SEQ ID NO: 6679
  misc_feature 1..1119: note = Synthetic polypeptide
  source 1..1119: mol_type = other DNA

SEQ ID NO: 13521 - DNA, 205 bp, synthetic construct; identical to SEQ ID NO: 12409
  misc_feature 1..205: note = Synthetic polypeptide
  source 1..205: mol_type = other DNA

SEQ ID NO: 13522 - DNA, 154 bp, synthetic construct; identical to SEQ ID NO: 12410
  misc_feature 1..154: note = Synthetic polypeptide
  source 1..154: mol_type = other DNA

SEQ ID NO: 13523 - DNA, 341 bp, synthetic construct
  misc_feature 1..341: note = Synthetic polypeptide
  source 1..341: mol_type = other DNA
aaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaa

SEQ ID NO: 13524 - DNA, 536 bp, synthetic construct
  misc_feature 1..536: note = Synthetic polypeptide
  source 1..536: mol_type = other DNA
aaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttga

SEQ ID NO: 13525 - DNA, 276 bp, synthetic construct
  misc_feature 1..276: note = Synthetic polypeptide
  source 1..276: mol_type = other DNA
ggccaggcgcagtggctcacacctgtaatcccagcactttgggaggctgaggcaggcggatcatgaggtcaggagatcgagaccatcctggctaacatgcgcccctttcctgtgtctgacagcgagtcaccaacagcacgcctttacagctgcgtgaggagagccccgtggatcccgcacaggggtacccgtgtccgcttgcgccgtcggaccttgtggactcgattgctctgcaccagggttgatttcctccattccttacgccctctgccatga

SEQ ID NO: 13526 - DNA, 1643 bp, synthetic construct; identical to SEQ ID NO: 7549
  misc_feature 1..1643: note = Synthetic polypeptide
  source 1..1643: mol_type = other DNA

SEQ ID NO: 13527 - DNA, 1457 bp, synthetic construct; identical to SEQ ID NO: 7550
  misc_feature 1..1457: note = Synthetic polypeptide
  source 1..1457: mol_type = other DNA

SEQ ID NO: 13528 - DNA, 134 bp, synthetic construct
  misc_feature 1..134: note = Synthetic polypeptide
  source 1..134: mol_type = other DNA
gaggaggagccaagatggccgaataggaacagctccggtctacagctcccagcgtgagcgacgcagaagacgggtgatttctgcatttccatctgagaacttcactgtatgccatacagcaacagagaaagtga

SEQ ID NO: 13529 - DNA, 740 bp, synthetic construct; identical to SEQ ID NO: 7794
  misc_feature 1..740: note = Synthetic polypeptide
  source 1..740: mol_type = other DNA

SEQ ID NO: 13530 - DNA, 1389 bp, synthetic construct
  misc_feature 1..1389: note = Synthetic polypeptide
  source 1..1389: mol_type = other DNA
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13531 - DNA, 1245 bp, synthetic construct
  misc_feature 1..1245: note = Synthetic polypeptide
  source 1..1245: mol_type = other DNA
ggccaggcgcggtggctcatgcctgtaatcccagcactttgggaggtgaaggtggacggatcacgagatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13532 - DNA, 194 bp, synthetic construct
  misc_feature 1..194: note = Synthetic polypeptide
  source 1..194: mol_type = other DNA
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacat

SEQ ID NO: 13533 - DNA, 216 bp, synthetic construct
  misc_feature 1..216: note = Synthetic polypeptide
  source 1..216: mol_type = other DNA
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 13534 - DNA, 392 bp, synthetic construct
  misc_feature 1..392: note = Synthetic polypeptide
  source 1..392: mol_type = other DNA
ggcccagcgcggtggcttagaggtataatcccagcactttggaggccgaggcgggcggatcacgaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctga

SEQ ID NO: 13535 - DNA, 406 bp, synthetic construct
  misc_feature 1..406: note = Synthetic polypeptide
  source 1..406: mol_type = other DNA
ggcccagcgcggtggcttagaggtataatcccagcactttggaggccgaggcgggcggatcacgaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagttgctcaggagaattagaaggcttaggatcaatatgtcatagcacacatcggacatttggaaaacagcagtggcaacaactgtatgacacacttaatgcctggaaacaaaatctgaacaaagtgaaaaacagcct

SEQ ID NO: 13536 - DNA, 1745 bp, synthetic construct
  misc_feature 1..1745: note = Synthetic polypeptide
  source 1..1745: mol_type = other DNA
acccagcccagttcatggcttgtttggcagcaaccctgagacgctttacagtcctagaccctaaaaggtcaaaaggctgtcttattctcaatatacattttattacccaatctgctcctgacattaaataaaactccaaaaattaaattccagccctcaaaccccacaataagatttaattaacctcaccttcaaagtatacaataatagaaaaaagttgcaattccttgcctccactgtaagacaaaccccagccacatctccagcaaacaagaacttccaaacgcctgaaccacagcggccaggcattcctccagaacctcctcccccaggagcttcctacaagtgccagaaatctgaccaccaggccaaggaatgcccacagcccaggattcctcctaagccacatcccatctgtgcaggaccccactggaaatcagaatgttcaactcacttggcaaccactcccagagcccctggaactctggcccaaggctctctgactccttcccagatcttctcggcttagcagctgaagactgacaccgcctgatcgcctcagaagcctacaggaccaacacagacactaagtaactctcacagtagaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtag

SEQ ID NO: 13537 - DNA, 2232 bp, synthetic construct; identical to SEQ ID NO: 9562
  misc_feature 1..2232: note = Synthetic polypeptide
  source 1..2232: mol_type = other DNA

SEQ ID NO: 13538 - DNA, 834 bp, synthetic construct; identical to SEQ ID NO: 9563
  misc_feature 1..834: note = Synthetic polypeptide
  source 1..834: mol_type = other DNA

SEQ ID NO: 13539 - DNA, 847 bp, synthetic construct; identical to SEQ ID NO: 9564
  misc_feature 1..847: note = Synthetic polypeptide
  source 1..847: mol_type = other DNA

SEQ ID NO: 13540 - DNA, 262 bp, synthetic construct
  misc_feature 1..262: note = Synthetic polypeptide
  source 1..262: mol_type = other DNA
cagacttcctaccgggagcactgcagtcacttctgaacaggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaa

SEQ ID NO: 13541 - DNA, 145 bp, synthetic construct
  misc_feature 1..145: note = Synthetic polypeptide
  source 1..145: mol_type = other DNA
cagacttcctaccgggagcactgcagtcacttctgaacaggatattatcaactcactggtaacaacagtattcatgctcatcgtatctgtgttggcactgataccagaaaccacaacattgacagttggtggagggttattttaa

SEQ ID NO: 13542 - DNA, 844 bp, synthetic construct
  misc_feature 1..844: note = Synthetic polypeptide
  source 1..844: mol_type = other DNA
ctcctctccccatgctcgttgcaccctgttctggcgaagggctgcgccatccacagcggcgctcaggccaggaccagggggtccttggtttcttcctctccctccctcaacacatagcctgttcccagggttctagctttgtctccctgttgctactgccagggctctggtctggccaccatcatcttctcccgactctgtccacagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataa

SEQ ID NO: 13543 - DNA, 293 bp, synthetic construct
  misc_feature 1..293: note = Synthetic polypeptide
  source 1..293: mol_type = other DNA
aggctgaagtggagagatcgcctgagcccaggaggtcaaggctacagtgagccgtgactgcaccactgcactccaccctgggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataa

SEQ ID NO: 13544 - DNA, 368 bp, synthetic construct
  misc_feature 1..368: note = Synthetic polypeptide
  source 1..368: mol_type = other DNA
aggctgaagtggagagatcgcctgagcccaggaggtcaaggctacagtgagccgtgactgcaccactgcactccaccctgggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttga

SEQ ID NO: 13545 - DNA, 1657 bp, synthetic construct
  misc_feature 1..1657: note = Synthetic polypeptide
  source 1..1657: mol_type = other DNA
ccgggtgcagtggctcacgcagtaatcctagcaatttgggaggccaagggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctga

SEQ ID NO: 13546 - DNA, 440 bp, synthetic construct
  misc_feature 1..440: note = Synthetic polypeptide
  source 1..440: mol_type = other DNA
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtag

SEQ ID NO: 13547 - DNA, 437 bp, synthetic construct
  misc_feature 1..437: note = Synthetic polypeptide
  source 1..437: mol_type = other DNA
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggtgcgttctacttgtacttcgttattccttagctatgtagatggagtgaagttttgctccccacaagcagaggtccagattccagccatgacagttactctgggcccttgcttctcagatatactttag

SEQ ID NO: 13548 - DNA, 566 bp, synthetic construct
  misc_feature 1..566: note = Synthetic polypeptide
  source 1..566: mol_type = other DNA
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagagcaacttagtaaaagacaagtaagacaggagctggggaccatggaagaaacatcccatgtgctttatcgaagtgccaagttgggaccacgggccgggctagaacgatccatggaaaagttctgtgctcaggggaacaactcaaattcagacattttgctagggctaagggaaatgagctggtaccttcgaatcagcttccagaacgcctgcagtgcaagttctcaattacggcatgcaaatgatttccttaaaaattaa

SEQ ID NO: 13549 - DNA, 190 bp, synthetic construct
  misc_feature 1..190: note = Synthetic polypeptide
  source 1..190: mol_type = other DNA
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactga

SEQ ID NO: 13550 - DNA, 77 bp, synthetic construct
  misc_feature 1..77: note = Synthetic polypeptide
  source 1..77: mol_type = other DNA
gagtctcagagcccagattctagtcctgttaaagttccttacctgctgtatctctttcactgggcctgcctcaatga

SEQ ID NO: 13551 - DNA, 768 bp, synthetic construct
  misc_feature 1..768: note = Synthetic polypeptide
  source 1..768: mol_type = other DNA
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctga

SEQ ID NO: 13552 - DNA, 400 bp, synthetic construct
  misc_feature 1..400: note = Synthetic polypeptide
  source 1..400: mol_type = other DNA
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagctt

SEQ ID NO: 13553 - DNA, 371 bp, synthetic construct
  misc_feature 1..371: note = Synthetic polypeptide
  source 1..371: mol_type = other DNA
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagcctt

SEQ ID NO: 13554 - DNA, 457 bp, synthetic construct
  misc_feature 1..457: note = Synthetic polypeptide
  source 1..457: mol_type = other DNA
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttga

SEQ ID NO: 13555 - DNA, 340 bp, synthetic construct; identical to SEQ ID NO: 12511
  misc_feature 1..340: note = Synthetic polypeptide
  source 1..340: mol_type = other DNA

SEQ ID NO: 13556 - DNA, 116 bp, synthetic construct; identical to SEQ ID NO: 12512
  misc_feature 1..116: note = Synthetic polypeptide
  source 1..116: mol_type = other DNA

SEQ ID NO: 13557 - DNA, 247 bp, synthetic construct; identical to SEQ ID NO: 12513
  misc_feature 1..247: note = Synthetic polypeptide
  source 1..247: mol_type = other DNA

SEQ ID NO: 13558 - DNA, 307 bp, synthetic construct; identical to SEQ ID NO: 12514
  misc_feature 1..307: note = Synthetic polypeptide
  source 1..307: mol_type = other DNA

SEQ ID NO: 13559 - DNA, 378 bp, synthetic construct
  misc_feature 1..378: note = Synthetic polypeptide
  source 1..378: mol_type = other DNA
tgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaa

SEQ ID NO: 13560 - DNA, 2373 bp, synthetic construct
  misc_feature 1..2373: note = Synthetic polypeptide
  source 1..2373: mol_type = other DNA
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaa

SEQ ID NO: 13561 - DNA, 2208 bp, synthetic construct
  misc_feature 1..2208: note = Synthetic polypeptide
  source 1..2208: mol_type = other DNA
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaa

SEQ ID NO: 13562 - DNA, 512 bp, synthetic construct
  misc_feature 1..512: note = Synthetic polypeptide
  source 1..512: mol_type = other DNA
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 13563 - DNA, 487 bp, synthetic construct; identical to SEQ ID NO: 8443
  misc_feature 1..487: note = Synthetic polypeptide
  source 1..487: mol_type = other DNA

SEQ ID NO: 13564 - DNA, 466 bp, synthetic construct; identical to SEQ ID NO: 8444
  misc_feature 1..466: note = Synthetic polypeptide
  source 1..466: mol_type = other DNA

SEQ ID NO: 13565 - DNA, 411 bp, synthetic construct; identical to SEQ ID NO: 6630
  misc_feature 1..411: note = Synthetic polypeptide
  source 1..411: mol_type = other DNA

SEQ ID NO: 13566 - DNA, 1775 bp, synthetic construct; identical to SEQ ID NO: 568
  misc_feature 1..1775: note = Synthetic polypeptide
  source 1..1775: mol_type = other DNA

SEQ ID NO: 13567 - DNA, 1570 bp, synthetic construct
  misc_feature 1..1570: note = Synthetic polypeptide
  source 1..1570: mol_type = other DNA
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaa

SEQ ID NO: 13568 - DNA, 808 bp, synthetic construct
  misc_feature 1..808: note = Synthetic polypeptide
  source 1..808: mol_type = other DNA
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaa

SEQ ID NO: 13569 - DNA, 397 bp, synthetic construct
  misc_feature 1..397: note = Synthetic polypeptide
  source 1..397: mol_type = other DNA
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaa

SEQ ID NO: 13570 - DNA, 765 bp, synthetic construct
  misc_feature 1..765: note = Synthetic polypeptide
  source 1..765: mol_type = other DNA
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatgg

SEQ ID NO: 13571 - DNA, 1957 bp, synthetic construct
  misc_feature 1..1957: note = Synthetic polypeptide
  source 1..1957: mol_type = other DNA
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaa

SEQ ID NO: 13572 - DNA, 644 bp, synthetic construct
  misc_feature 1..644: note = Synthetic polypeptide
  source 1..644: mol_type = other DNA
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataa

SEQ ID NO: 13573 - DNA, 719 bp, synthetic construct
  misc_feature 1..719: note = Synthetic polypeptide
  source 1..719: mol_type = other DNA
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttga

SEQ ID NO: 13574 - DNA, 497 bp, synthetic construct
  misc_feature 1..497: note = Synthetic polypeptide
  source 1..497: mol_type = other DNA
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggaggctgggagcccttgggacactgtggagacaggagcaggccccctgctcagggctgcccctga

SEQ ID NO: 13575 - DNA, 1052 bp, synthetic construct; identical to SEQ ID NO: 12532
  misc_feature 1..1052: note = Synthetic polypeptide
  source 1..1052: mol_type = other DNA

SEQ ID NO: 13576 - DNA, 473 bp, synthetic construct
  misc_feature 1..473: note = Synthetic polypeptide
  source 1..473: mol_type = other DNA
gatcattttttaggctgtttcacaaggcattcctgcatcagtggcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctga

SEQ ID NO: 13577 - DNA, 612 bp, synthetic construct
  misc_feature 1..612: note = Synthetic polypeptide
  source 1..612: mol_type = other DNA
tattttaaaactattattattttaatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 13578 - DNA, 218 bp, synthetic construct; identical to SEQ ID NO: 6903
  misc_feature 1..218: note = Synthetic polypeptide
  source 1..218: mol_type = other DNA

SEQ ID NO: 13579 - DNA, 2471 bp, synthetic construct; identical to SEQ ID NO: 576
  misc_feature 1..2471: note = Synthetic polypeptide
  source 1..2471: mol_type = other DNA

SEQ ID NO: 13580 - DNA, 340 bp, synthetic construct; identical to SEQ ID NO: 8550
  misc_feature 1..340: note = Synthetic polypeptide
  source 1..340: mol_type = other DNA

SEQ ID NO: 13581 - DNA, 1079 bp, synthetic construct
  misc_feature 1..1079: note = Synthetic polypeptide
  source 1..1079: mol_type = other DNA
gcagggtgcggtggctcacccctgtaattccagccctttgggaggctgaggtgggcagactgctttgagctcaggagttggagaccagcctggggaacatggcaacaccacctccctacaaaagacacaaaaattagccagacgtagtggctcatgcctgtagttccagcggctcaggaggctgaggctggaggatcacttgagccttcaagagggaaacagaagtggcagtgagccaagatcacaccattgcacaccatcctgggtgacagaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaa

SEQ ID NO: 13582 - DNA, 746 bp, synthetic construct
  misc_feature 1..746: note = Synthetic polypeptide
  source 1..746: mol_type = other DNA
gcagggtgcggtggctcacccctgtaattccagccctttgggaggctgaggtgggcagactgctttgagctcaggagttggagaccagcctggggaacatggcaacaccacctccctacaaaagacacaaaaattagccagacgtagtggctcatgcctgtagttccagcggctcaggaggctgaggctggaggatcacttgagccttcaagagggaaacagaagtggcagtgagccaagatcacaccattgcacaccatcctgggtgacagaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctga

SEQ ID NO: 13583 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13584 - DNA, 1122 bp, synthetic construct
  misc_feature 1..1122: note = Synthetic polypeptide
  source 1..1122: mol_type = other DNA
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtag

SEQ ID NO: 13585 - DNA, 501 bp, synthetic construct
  misc_feature 1..501: note = Synthetic polypeptide
  source 1..501: mol_type = other DNA
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgctgaacatactgacttgtggagtcattggctcctattcggtggttttagccattga

SEQ ID NO: 13586 - DNA, 639 bp, synthetic construct
  misc_feature 1..639: note = Synthetic polypeptide
  source 1..639: mol_type = other DNA
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactggagacaggatctctttctgtcacccatgctggactgcagtga

SEQ ID NO: 13587 - DNA, 342 bp, synthetic construct
  misc_feature 1..342: note = Synthetic polypeptide
  source 1..342: mol_type = other DNA
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctagctgtgctgtacctgcttctctgcctctccacctcatcaccctcctttatcactggattattttaa

SEQ ID NO: 13588 - DNA, 445 bp, synthetic construct
  misc_feature 1..445: note = Synthetic polypeptide
  source 1..445: mol_type = other DNA
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatg

SEQ ID NO: 13589 - DNA, 755 bp, synthetic construct; identical to SEQ ID NO: 13583
  misc_feature 1..755: note = Synthetic polypeptide
  source 1..755: mol_type = other DNA

SEQ ID NO: 13590 - DNA, 335 bp, synthetic construct
  misc_feature 1..335: note = Synthetic polypeptide
  source 1..335: mol_type = other DNA
ctgtctgagccccggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtag

SEQ ID NO: 13591 - DNA, 503 bp, synthetic construct; identical to SEQ ID NO: 493
  misc_feature 1..503: note = Synthetic polypeptide
  source 1..503: mol_type = other DNA

SEQ ID NO: 13592 - DNA, 476 bp, synthetic construct; identical to SEQ ID NO: 495
  misc_feature 1..476: note = Synthetic polypeptide
  source 1..476: mol_type = other DNA

SEQ ID NO: 13593 - DNA, 539 bp, synthetic construct; identical to SEQ ID NO: 496
  misc_feature 1..539: note = Synthetic polypeptide
  source 1..539: mol_type = other DNA

SEQ ID NO: 13594 - DNA, 1624 bp, synthetic construct
  misc_feature 1..1624: note = Synthetic polypeptide
  source 1..1624: mol_type = other DNA
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggaggtgaggagcgtctctgcccggccgccccgtctgagaagtgaggagaccctccgcccggcagccgccccgtctgagaagttaggagcctctccgcccggcagccgccccgtctgggaagtgaggagcgtctctgcccggcagccaccccgtccgggagggaggtggggggggtcagccccccgcccggccagccgccccgtccgggaggtgaggggaacctctgcccggccgcccctactgggaagtgaggagcccctctgcctagccagctgccccgtccgggagggaggtgggggggtcagccccccgcccggccagccgccccgtccgggagggaggtgggggggtcagccccccgcccggccagccgccccgtccgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13595 - DNA, 463 bp, synthetic construct; identical to SEQ ID NO: 7109
  misc_feature 1..463: note = Synthetic polypeptide
  source 1..463: mol_type = other DNA

SEQ ID NO: 13596 - DNA, 663 bp, synthetic construct
  misc_feature 1..663: note = Synthetic polypeptide
  source 1..663: mol_type = other DNA
gccaggtgcagtggctcactcctgtaatcctaacactttgggaggctgaggcaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataa

SEQ ID NO: 13597 - DNA, 236 bp, synthetic construct
  misc_feature 1..236: note = Synthetic polypeptide
  source 1..236: mol_type = other DNA
gccaggtgcagtggctcactcctgtaatcctaacactttgggaggctgaggcaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaa

SEQ ID NO: 13598 - DNA, 683 bp, synthetic construct; identical to SEQ ID NO: 12254
  misc_feature 1..683: note = Synthetic polypeptide
  source 1..683: mol_type = other DNA

SEQ ID NO: 13599 - DNA, 2094 bp, synthetic construct; identical to SEQ ID NO: 865
  misc_feature 1..2094: note = Synthetic polypeptide
  source 1..2094: mol_type = other DNA

SEQ ID NO: 13600 - DNA, 2067 bp, synthetic construct; identical to SEQ ID NO: 868
  misc_feature 1..2067: note = Synthetic polypeptide
  source 1..2067: mol_type = other DNA

SEQ ID NO: 13601 - DNA, 1234 bp, synthetic construct
  misc_feature 1..1234: note = Synthetic polypeptide
  source 1..1234: mol_type = other DNA
ggggtggggtgggggtggggaggacacacacttgtagctagggcaggctctggtagcatctgtgtacccatcgtggcccctctgccctgttgttattccaccttggctccgggcccctgtgtgcctcagtgtctgcacctgtgatgaacctgccctgcaaggttgctgaggagattaagtaagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctag

SEQ ID NO: 13602 - DNA, 339 bp, synthetic construct
  misc_feature 1..339: note = Synthetic polypeptide
  source 1..339: mol_type = other DNA
gttgcgccgccccggccaagcctcagcctttctgggccttagcttcttcacgtgtaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13603 - DNA, 1554 bp, synthetic construct
  misc_feature 1..1554: note = Synthetic polypeptide
  source 1..1554: mol_type = other DNA
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtag

SEQ ID NO: 13604 - DNA, 444 bp, synthetic construct
  misc_feature 1..444: note = Synthetic polypeptide
  source 1..444: mol_type = other DNA
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagc

SEQ ID NO: 13605 - DNA, 184 bp, synthetic construct
  misc_feature 1..184: note = Synthetic polypeptide
  source 1..184: mol_type = other DNA
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctgggg

SEQ ID NO: 13606 - DNA, 981 bp, synthetic construct; identical to SEQ ID NO: 12548
  misc_feature 1..981: note = Synthetic polypeptide
  source 1..981: mol_type = other DNA

SEQ ID NO: 13607 - DNA, 628 bp, synthetic construct
  misc_feature 1..628: note = Synthetic polypeptide
  source 1..628: mol_type = other DNA
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttag

SEQ ID NO: 13608 - DNA, 329 bp, synthetic construct
  misc_feature 1..329: note = Synthetic polypeptide
  source 1..329: mol_type = other DNA
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 13609 - DNA, 241 bp, synthetic construct
  misc_feature 1..241: note = Synthetic polypeptide
  source 1..241: mol_type = other DNA
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaa

SEQ ID NO: 13610 - DNA, 144 bp, synthetic construct
  misc_feature 1..144: note = Synthetic polypeptide
  source 1..144: mol_type = other DNA
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccct

SEQ ID NO: 13611 - DNA, 755 bp, synthetic construct
  misc_feature 1..755: note = Synthetic polypeptide
  source 1..755: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13612 - DNA, 2158 bp, synthetic construct; identical to SEQ ID NO: 514
  misc_feature 1..2158: note = Synthetic polypeptide
  source 1..2158: mol_type = other DNA

SEQ ID NO: 13613 - DNA, 124 bp, synthetic construct; identical to SEQ ID NO: 515
  misc_feature 1..124: note = Synthetic polypeptide
  source 1..124: mol_type = other DNA

SEQ ID NO: 13614 - DNA, 166 bp, synthetic construct; identical to SEQ ID NO: 516
  misc_feature 1..166: note = Synthetic polypeptide
  source 1..166: mol_type = other DNA

SEQ ID NO: 13615 - DNA, 1776 bp, synthetic construct; identical to SEQ ID NO: 517
  misc_feature 1..1776: note = Synthetic polypeptide
  source 1..1776: mol_type = other DNA

SEQ ID NO: 13616 - DNA, 319 bp, synthetic construct; identical to SEQ ID NO: 520
  misc_feature 1..319: note = Synthetic polypeptide
  source 1..319: mol_type = other DNA

SEQ ID NO: 13617 - DNA, 755 bp, synthetic construct; identical to SEQ ID NO: 13611
  misc_feature 1..755: note = Synthetic polypeptide
  source 1..755: mol_type = other DNA

SEQ ID NO: 13618 - DNA, 225 bp, synthetic construct; identical to SEQ ID NO: 7100
  misc_feature 1..225: note = Synthetic polypeptide
  source 1..225: mol_type = other DNA

SEQ ID NO: 13619 - DNA, 481 bp, synthetic construct
  misc_feature 1..481: note = Synthetic polypeptide
  source 1..481: mol_type = other DNA
ggctaaaggagatgcagcaggagatcagagggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataa

SEQ ID NO: 13620 - DNA, 2528 bp, synthetic construct
  misc_feature 1..2528: note = Synthetic polypeptide
  source 1..2528: mol_type = other DNA
ggctaaaggagatgcagcaggagatcagagggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataa

SEQ ID NO: 13621 - DNA, 198 bp, synthetic construct; identical to SEQ ID NO: 8406
  misc_feature 1..198: note = Synthetic polypeptide
  source 1..198: mol_type = other DNA

SEQ ID NO: 13622 - DNA, 214 bp, synthetic construct
  misc_feature 1..214: note = Synthetic polypeptide
  source 1..214: mol_type = other DNA
ggctgggcccagtagctcgtgcctgtaatcccagcattttgaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 13623 - DNA, 462 bp, synthetic construct
  misc_feature 1..462: note = Synthetic polypeptide
  source 1..462: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataa

SEQ ID NO: 13624 - DNA, 166 bp, synthetic construct
  misc_feature 1..166: note = Synthetic polypeptide
  source 1..166: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctg

SEQ ID NO: 13625 - DNA, 255 bp, synthetic construct
  misc_feature 1..255: note = Synthetic polypeptide
  source 1..255: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaa

SEQ ID NO: 13626 - DNA, 275 bp, synthetic construct
  misc_feature 1..275: note = Synthetic polypeptide
  source 1..275: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaaga

SEQ ID NO: 13627 - DNA, 139 bp, synthetic construct
  misc_feature 1..139: note = Synthetic polypeptide
  source 1..139: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggaga

SEQ ID NO: 13628 - DNA, 292 bp, synthetic construct
  misc_feature 1..292: note = Synthetic polypeptide
  source 1..292: mol_type = other DNA
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgt

SEQ ID NO: 13629 - DNA, 284 bp, synthetic construct
  misc_feature 1..284: note = Synthetic polypeptide
  source 1..284: mol_type = other DNA
tcctgttcatcctttgagcttctgcttaaacatcacttctgagagtccttctctgatttctcatctagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataa

SEQ ID NO: 13630 - DNA, 77 bp, synthetic construct
  misc_feature 1..77: note = Synthetic polypeptide
  source 1..77: mol_type = other DNA
tcctgttcatcctttgagcttctgcttaaacatcacttctgagagtccttctctgatttctcatctagtattctgaa

SEQ ID NO: 13631 - DNA, 97 bp, synthetic construct
  misc_feature 1..97: note = Synthetic polypeptide
  source 1..97: mol_type = other DNA
tcctgttcatcctttgagcttctgcttaaacatcacttctgagagtccttctctgatttctcatctagtattctgaaaaggaggacaaatatgaaga

SEQ ID NO: 13632 - DNA, 114 bp, synthetic construct
  misc_feature 1..114: note = Synthetic polypeptide
  source 1..114: mol_type = other DNA
tcctgttcatcctttgagcttctgcttaaacatcacttctgagagtccttctctgatttctcatctagtattctgaaaaggaggacaaatatgaagaagaaattaaacttctgt

SEQ ID NO: 13633 - DNA, 4686 bp, synthetic construct; identical to SEQ ID NO: 8201
  misc_feature 1..4686: note = Synthetic polypeptide
  source 1..4686: mol_type = other DNA

SEQ ID NO: 13634 - DNA, 6266 bp, synthetic construct; identical to SEQ ID NO: 8202
  misc_feature 1..6266: note = Synthetic polypeptide
  source 1..6266: mol_type = other DNA

SEQ ID NO: 13635 - DNA, 5837 bp, synthetic construct; identical to SEQ ID NO: 8203
  misc_feature 1..5837: note = Synthetic polypeptide
  source 1..5837: mol_type = other DNA

SEQ ID NO: 13636 - DNA, 367 bp, synthetic construct
  misc_feature 1..367: note = Synthetic polypeptide
  source 1..367: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13637 - DNA, 358 bp, synthetic construct
  misc_feature 1..358: note = Synthetic polypeptide
  source 1..358: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13638 - DNA, 456 bp, synthetic construct
  misc_feature 1..456: note = Synthetic polypeptide
  source 1..456: mol_type = other DNA
ggccaggtgccgtggctcacacttgtaatcccagcactttgggaggccaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactga

SEQ ID NO: 13639 - DNA, 2417 bp, synthetic construct
  misc_feature 1..2417: note = Synthetic polypeptide
  source 1..2417: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 13640 - DNA, 1019 bp, synthetic construct
  misc_feature 1..1019: note = Synthetic polypeptide
  source 1..1019: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 13641 - DNA, 1032 bp, synthetic construct
  misc_feature 1..1032: note = Synthetic polypeptide
  source 1..1032: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 13642 - DNA, 905 bp, synthetic construct
  misc_feature 1..905: note = Synthetic polypeptide
  source 1..905: mol_type = other DNA
agcaatgaaaagacgcctggttgggagttcagacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatga

SEQ ID NO: 13643 - DNA, 812 bp, synthetic construct
  misc_feature 1..812: note = Synthetic polypeptide
  source 1..812: mol_type = other DNA
agcaatgaaaagacgcctggttgggagttcagacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatga

SEQ ID NO: 13644 - DNA, 314 bp, synthetic construct
  misc_feature 1..314: note = Synthetic polypeptide
  source 1..314: mol_type = other DNA
agcaatgaaaagacgcctggttgggagttcagacctatgccagatttactggtgctccactgaaggtacacaagatcagcaacccctggcagagcccttcaggtacccagtatcccttgggggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatag

SEQ ID NO: 13645 - DNA, 224 bp, synthetic construct; identical to SEQ ID NO: 12336
  misc_feature 1..224: note = Synthetic polypeptide
  source 1..224: mol_type = other DNA

SEQ ID NO: 13646 - DNA, 831 bp, synthetic construct
  misc_feature 1..831: note = Synthetic polypeptide
  source 1..831: mol_type = other DNA
acctctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtga

SEQ ID NO: 13647 - DNA, 239 bp, synthetic construct
  misc_feature 1..239: note = Synthetic polypeptide
  source 1..239: mol_type = other DNA
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaa

SEQ ID NO: 13648 - DNA, 379 bp, synthetic construct
  misc_feature 1..379: note = Synthetic polypeptide
  source 1..379: mol_type = other DNA
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctga

SEQ ID NO: 13649 - DNA, 761 bp, synthetic construct
  misc_feature 1..761: note = Synthetic polypeptide
  source 1..761: mol_type = other DNA
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtgcttctggggtcctga

SEQ ID NO: 13650 - DNA, 863 bp, synthetic construct
  misc_feature 1..863: note = Synthetic polypeptide
  source 1..863: mol_type = other DNA
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctga

SEQ ID NO: 13651 - DNA, 806 bp, synthetic construct; identical to SEQ ID NO: 6950
  misc_feature 1..806: note = Synthetic polypeptide
  source 1..806: mol_type = other DNA

SEQ ID NO: 13652 - DNA, 331 bp, synthetic construct; identical to SEQ ID NO: 8434
  misc_feature 1..331: note = Synthetic polypeptide
  source 1..331: mol_type = other DNA

SEQ ID NO: 13653 - DNA, 1538 bp, synthetic construct; identical to SEQ ID NO: 8435
  misc_feature 1..1538: note = Synthetic polypeptide
  source 1..1538: mol_type = other DNA

SEQ ID NO: 13654 - DNA, 884 bp, synthetic construct; identical to SEQ ID NO: 8436
  misc_feature 1..884: note = Synthetic polypeptide
  source 1..884: mol_type = other DNA

SEQ ID NO: 13655 - DNA, 343 bp, synthetic construct; identical to SEQ ID NO: 8437
  misc_feature 1..343: note = Synthetic polypeptide
  source 1..343: mol_type = other DNA

SEQ ID NO: 13656 - DNA, 401 bp, synthetic construct; identical to SEQ ID NO: 8438
  misc_feature 1..401: note = Synthetic polypeptide
  source 1..401: mol_type = other DNA

SEQ ID NO: 13657 - DNA, 1535 bp, synthetic construct; identical to SEQ ID NO: 8439
  misc_feature 1..1535: note = Synthetic polypeptide
  source 1..1535: mol_type = other DNA

SEQ ID NO: 13658 - DNA, 255 bp, synthetic construct; identical to SEQ ID NO: 8440
  misc_feature 1..255: note = Synthetic polypeptide
  source 1..255: mol_type = other DNA

SEQ ID NO: 13659 - DNA, 88 bp, synthetic construct; identical to SEQ ID NO: 8441
  misc_feature 1..88: note = Synthetic polypeptide
  source 1..88: mol_type = other DNA

SEQ ID NO: 13660 - DNA, 429 bp, synthetic construct; identical to SEQ ID NO: 8442
  misc_feature 1..429: note = Synthetic polypeptide
  source 1..429: mol_type = other DNA

SEQ ID NO: 13661 - DNA, 928 bp, synthetic construct; identical to SEQ ID NO: 11299
  misc_feature 1..928: note = Synthetic polypeptide
  source 1..928: mol_type = other DNA

SEQ ID NO: 13662 - DNA, 1942 bp, synthetic construct; identical to SEQ ID NO: 11300
  misc_feature 1..1942: note = Synthetic polypeptide
  source 1..1942: mol_type = other DNA

SEQ ID NO: 13663 - DNA, 1660 bp, synthetic construct; identical to SEQ ID NO: 11301
  misc_feature 1..1660: note = Synthetic polypeptide
  source 1..1660: mol_type = other DNA

SEQ ID NO: 13664 - DNA, 175 bp, synthetic construct; identical to SEQ ID NO: 11302
  misc_feature 1..175: note = Synthetic polypeptide
  source 1..175: mol_type = other DNA

SEQ ID NO: 13665 - DNA, 547 bp, synthetic construct; identical to SEQ ID NO: 11303
  misc_feature 1..547: note = Synthetic polypeptide
  source 1..547: mol_type = other DNA

SEQ ID NO: 13666 - DNA, 481 bp, synthetic construct; identical to SEQ ID NO: 11304
  misc_feature 1..481: note = Synthetic polypeptide
  source 1..481: mol_type = other DNA

SEQ ID NO: 13667 - DNA, 620 bp, synthetic construct; identical to SEQ ID NO: 11305
  misc_feature 1..620: note = Synthetic polypeptide
  source 1..620: mol_type = other DNA

SEQ ID NO: 13668 - DNA, 819 bp, synthetic construct
  misc_feature 1..819: note = Synthetic polypeptide
  source 1..819: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 13669 - DNA, 885 bp, synthetic construct
  misc_feature 1..885: note = Synthetic polypeptide
  source 1..885: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 13670 - DNA, 954 bp, synthetic construct
  misc_feature 1..954: note = Synthetic polypeptide
  source 1..954: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 13671 - DNA, 813 bp, synthetic construct
  misc_feature 1..813: note = Synthetic polypeptide
  source 1..813: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 13672 - DNA, 2174 bp, synthetic construct
  misc_feature 1..2174: note = Synthetic polypeptide
  source 1..2174: mol_type = other DNA
ggcggcggcggcggcgggcgcagagcgcggcatgggcgcccgggccgcggggcctggcggcggcgggcggacgggcgcgcggctgcgggcgcagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctga

SEQ ID NO: 13673 - DNA, 899 bp, synthetic construct
  misc_feature 1..899: note = Synthetic polypeptide
  source 1..899: mol_type = other DNA
ggcggcggcggcggcgggcgcagagcgcggcatgggcgcccgggccgcggggcctggcggcggcgggcggacgggcgcgcggctgcgggcgcagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctgggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtag

SEQ ID NO: 13674 - DNA, 2256 bp, synthetic construct; identical to SEQ ID NO: 8407
  misc_feature 1..2256: note = Synthetic polypeptide
  source 1..2256: mol_type = other DNA

SEQ ID NO: 13675 - DNA, 552 bp, synthetic construct
  misc_feature 1..552: note = Synthetic polypeptide
  source 1..552: mol_type = other DNA
ggccaggcgcggtggctcacgcctgtaatcccagcacttagggaggctgaggcaggcggatcacgaggtcaggagatcaagaccatcctggctaacacgatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctga

SEQ ID NO: 13676 - DNA, 2624 bp, synthetic construct; identical to SEQ ID NO: 8408
  misc_feature 1..2624: note = Synthetic polypeptide
  source 1..2624: mol_type = other DNA

SEQ ID NO: 13677 - DNA, 2678 bp, synthetic construct; identical to SEQ ID NO: 8409
  misc_feature 1..2678: note = Synthetic polypeptide
  source 1..2678: mol_type = other DNA

SEQ ID NO: 13678 - DNA, 2717 bp, synthetic construct; identical to SEQ ID NO: 8410
  misc_feature 1..2717: note = Synthetic polypeptide
  source 1..2717: mol_type = other DNA

SEQ ID NO: 13679 - DNA, 2624 bp, synthetic construct; identical to SEQ ID NO: 8411
  misc_feature 1..2624: note = Synthetic polypeptide
  source 1..2624: mol_type = other DNA

SEQ ID NO: 13680 - DNA, 2783 bp, synthetic construct; identical to SEQ ID NO: 8412
  misc_feature 1..2783: note = Synthetic polypeptide
  source 1..2783: mol_type = other DNA

SEQ ID NO: 13681 - DNA, 2696 bp, synthetic construct; identical to SEQ ID NO: 8413
  misc_feature 1..2696: note = Synthetic polypeptide
  source 1..2696: mol_type = other DNA

SEQ ID NO: 13682 - DNA, 2678 bp, synthetic construct; identical to SEQ ID NO: 8414
  misc_feature 1..2678: note = Synthetic polypeptide
  source 1..2678: mol_type = other DNA

SEQ ID NO: 13683 - DNA, 677 bp, synthetic construct; identical to SEQ ID NO: 8415
  misc_feature 1..677: note = Synthetic polypeptide
  source 1..677: mol_type = other DNA

SEQ ID NO: 13684 - DNA, 122 bp, synthetic construct
  misc_feature 1..122: note = Synthetic polypeptide
  source 1..122: mol_type = other DNA
ggccaggtgttgtgactcacacttgtaatctcagcactttgagaggtcaaggcaggaggattgctcgaggcctggagtttgagaccagactggtcaggatgtgtttgaaagatgtatggtga

SEQ ID NO: 13685 - DNA, 108 bp, synthetic construct
  misc_feature 1..108: note = Synthetic polypeptide
  source 1..108: mol_type = other DNA
ggccaggtgttgtgactcacacttgtaatctcagcactttgagaggtcaaggcaggaggattgctcgaggcctggagtttgagaccagactggtcaggatgtgtttga

SEQ ID NO: 13686 - DNA, 3042 bp, synthetic construct; identical to SEQ ID NO: 8824
  misc_feature 1..3042: note = Synthetic polypeptide
  source 1..3042: mol_type = other DNA

SEQ ID NO: 13687 - DNA, 209 bp, synthetic construct
  misc_feature 1..209: note = Synthetic polypeptide
  source 1..209: mol_type = other DNA
gtggtcgggagagtgcacgccggtgccgcctgggctccagactgggcgcgaccactaacccggttaatgacctcgggcttaacttaaccccttcgctgctctgggcctgcgtttctccaccggtgaaatgaggtggtacagaagttggtcctgccctttgggcgactgaactacctgcccctggaacagcagtttatgccctgccttga

SEQ ID NO: 13688 - DNA, 957 bp, synthetic construct
  misc_feature 1..957: note = Synthetic polypeptide
  source 1..957: mol_type = other DNA
gtggtcgggagagtgcacgccggtgccgcctgggctccagactgggcgcgaccactaacccggttaatgacctcgggcttaacttaaccccttcgctgctctgggcctgcgtttctccaccggtgaaatgaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctga

SEQ ID NO: 13689 - DNA, 294 bp, synthetic construct
  misc_feature 1..294: note = Synthetic polypeptide
  source 1..294: mol_type = other DNA
gaggcagtggaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaa

SEQ ID NO: 13690 - DNA, 104 bp, synthetic construct
  misc_feature 1..104: note = Synthetic polypeptide
  source 1..104: mol_type = other DNA
gaggcagtggaccaccccgtggagctgctggcccgggacttcgagaagaactataacatgtacatcttccctgtacactggcagttcggccagctggaccagca

SEQ ID NO: 13691 - DNA, 460 bp, synthetic construct; identical to SEQ ID NO: 813
  misc_feature 1..460: note = Synthetic polypeptide
  source 1..460: mol_type = other DNA

SEQ ID NO: 13692 - DNA, 619 bp, synthetic construct
  misc_feature 1..619: note = Synthetic polypeptide
  source 1..619: mol_type = other DNA
ccatacttcgaattaggaatctttatcttttcccaagctagcaatgtgtggtacaatactctgttgcaatactcagcaggaacccacagctcccagtcacctgcccaatcacaggggtaaacaaccagtactctacggtgtactgtgttgctaggtgatttcacctaactgtaagctaatgtaagctagtgtaagctttttgagcacattgaaggccagactatggtgtttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtga

SEQ ID NO: 13693 - DNA, 352 bp, synthetic construct
  misc_feature 1..352: note = Synthetic polypeptide
  source 1..352: mol_type = other DNA
gcagtggcttgcgcctataatcccagcactttgggaggccgaggcatgtggatcacttgaagtcaggagttttaagaccagcctgggcaacgtggcgaaatcctgtctactaaaaatacaaaaattagccagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataa

SEQ ID NO: 13694 - DNA, 247 bp, synthetic construct
  misc_feature 1..247: note = Synthetic polypeptide
  source 1..247: mol_type = other DNA
gcagtggcttgcgcctataatcccagcactttgggaggccgaggcatgtggatcacttgaagtcaggagttttaagaccagcctgggcaacgtggcgaaatcctgtctactaaaaatacaaaaattagccagattataccgaaaagaagttctagagaaattaatagaaaaatgtgtttctaaaggctacgtcttccagatggagatgattgttcgggcaagacagttgaattatactattggcgag

SEQ ID NO: 13695 - DNA, 168 bp, synthetic construct
  misc_feature 1..168: note = Synthetic polypeptide
  source 1..168: mol_type = other DNA
ggccaggcacagttgctcacgcctctaattccagcactttggggggctgaggaggcagcgacccggaaacagcgtatcactgagaccgagtcgccttatcaggagctccagggtcagaggtcggatgtctacagcgacctcaacacacagaggccgtattacaaatga

SEQ ID NO: 13696 - DNA, 292 bp, synthetic construct
  misc_feature 1..292: note = Synthetic polypeptide
  source 1..292: mol_type = other DNA
ggccaggagtggtggctcacgcctgtaatcccagcactttgggaggccaagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtga

SEQ ID NO: 13697 - DNA, 87 bp, synthetic construct
  misc_feature 1..87: note = Synthetic polypeptide
  source 1..87: mol_type = other DNA
ggccaggagtggtggctcacgcctgtaatcccagcactttgggaggccaagaactcagcctcctcccaagctccctgtgggtcctag

SEQ ID NO: 13698 - DNA, 2287 bp, synthetic construct; identical to SEQ ID NO: 6799
  misc_feature 1..2287: note = Synthetic polypeptide
  source 1..2287: mol_type = other DNA

SEQ ID NO: 13699 - DNA, 2234 bp, synthetic construct; identical to SEQ ID NO: 6800
  misc_feature 1..2234: note = Synthetic polypeptide
  source 1..2234: mol_type = other DNA

SEQ ID NO: 13700 - DNA, 1597 bp, synthetic construct
  misc_feature 1..1597: note = Synthetic polypeptide
  source 1..1597: mol_type = other DNA
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtga

SEQ ID NO: 13701 - DNA, 893 bp, synthetic construct
  misc_feature 1..893: note = Synthetic polypeptide
  source 1..893: mol_type = other DNA
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggaca

SEQ ID NO: 13702 - DNA, 451 bp, synthetic construct
  misc_feature 1..451: note = Synthetic polypeptide
  source 1..451: mol_type = other DNA
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagttt

SEQ ID NO: 13703 - DNA, 3717 bp, synthetic construct; identical to SEQ ID NO: 7131
  misc_feature 1..3717: note = Synthetic polypeptide
  source 1..3717: mol_type = other DNA

SEQ ID NO: 13704 - DNA, 3636 bp, synthetic construct; identical to SEQ ID NO: 7132
  misc_feature 1..3636: note = Synthetic polypeptide
  source 1..3636: mol_type = other DNA

SEQ ID NO: 13705 - DNA, 3649 bp, synthetic construct; identical to SEQ ID NO: 10098
  misc_feature 1..3649: note = Synthetic polypeptide
  source 1..3649: mol_type = other DNA

SEQ ID NO: 13706 - DNA, 3478 bp, synthetic construct; identical to SEQ ID NO: 10099
  misc_feature 1..3478: note = Synthetic polypeptide
  source 1..3478: mol_type = other DNA

SEQ ID NO: 13707 - DNA, 3472 bp, synthetic construct; identical to SEQ ID NO: 10100
  misc_feature 1..3472: note = Synthetic polypeptide
  source 1..3472: mol_type = other DNA

SEQ ID NO: 13708 - DNA, 3457 bp, synthetic construct; identical to SEQ ID NO: 10101
  misc_feature 1..3457: note = Synthetic polypeptide
  source 1..3457: mol_type = other DNA

SEQ ID NO: 13709 - DNA, 472 bp, synthetic construct
  misc_feature 1..472: note = Synthetic polypeptide
  source 1..472: mol_type = other DNA
tgctgtggtttgaatgtgttccccaaagttcatgtgttggaaactttatctccaaagcaatagtaattaacaggtgattaggccatgagggctctgctgtaatgaatggattcgtgctgttatcacaggagcgggttccttatagaaggatgaatttgtccccccaccttttatttctctccctctctttgctcttccaccaggagatgatgcagcaagaaggccttctccagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatga

SEQ ID NO: 13710 - DNA, 468 bp, synthetic construct
  misc_feature 1..468: note = Synthetic polypeptide
  source 1..468: mol_type = other DNA
ggcgcggtggctcacgcctgtaatcccagcactttgggaggccaaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtga

SEQ ID NO: 13711 - DNA, 402 bp, synthetic construct
  misc_feature 1..402: note = Synthetic polypeptide
  source 1..402: mol_type = other DNA
ggcgcggtggctcacgcctgtaatcccagcactttgggaggccaaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaaggtacccttgtgtgggaagctgaggtgcccctgccaggagcaaggaagggtgcatccctgggctttcctcatctgggggctggataatcaaggggtgtcttctgggaggagctga

SEQ ID NO: 13712 - DNA, 736 bp, synthetic construct
  misc_feature 1..736: note = Synthetic polypeptide
  source 1..736: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaa

SEQ ID NO: 13713 - DNA, 241 bp, synthetic construct
  misc_feature 1..241: note = Synthetic polypeptide
  source 1..241: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcc

SEQ ID NO: 13714 - DNA, 226 bp, synthetic construct
  misc_feature 1..226: note = Synthetic polypeptide
  source 1..226: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggt

SEQ ID NO: 13715 - DNA, 211 bp, synthetic construct
  misc_feature 1..211: note = Synthetic polypeptide
  source 1..211: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaa

SEQ ID NO: 13716 - DNA, 162 bp, synthetic construct
  misc_feature 1..162: note = Synthetic polypeptide
  source 1..162: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacgg

SEQ ID NO: 13717 - DNA, 147 bp, synthetic construct
  misc_feature 1..147: note = Synthetic polypeptide
  source 1..147: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcag

SEQ ID NO: 13718 - DNA, 146 bp, synthetic construct
  misc_feature 1..146: note = Synthetic polypeptide
  source 1..146: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggca

SEQ ID NO: 13719 - DNA, 124 bp, synthetic construct
  misc_feature 1..124: note = Synthetic polypeptide
  source 1..124: mol_type = other DNA
gtggctcatcacgcctctaatcccagcactttgggaggccaaggccttcggggctgtggaagccatctctgaccggatctgcatccacaccaatgcgcacgtcagcgtggaggtgtcggcggag

SEQ ID NO: 13720 - DNA, 127 bp, synthetic construct; identical to SEQ ID NO: 8697
  misc_feature 1..127: note = Synthetic polypeptide
  source 1..127: mol_type = other DNA

SEQ ID NO: 13721 - DNA, 425 bp, synthetic construct
  misc_feature 1..425: note = Synthetic polypeptide
  source 1..425: mol_type = other DNA
ctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtga

SEQ ID NO: 13722 - DNA, 335 bp, synthetic construct
  misc_feature 1..335: note = Synthetic polypeptide
  source 1..335: mol_type = other DNA
ctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattag

SEQ ID NO: 13723 - DNA, 524 bp, synthetic construct; identical to SEQ ID NO: 7813
  misc_feature 1..524: note = Synthetic polypeptide
  source 1..524: mol_type = other DNA

SEQ ID NO: 13724 - DNA, 502 bp, synthetic construct; identical to SEQ ID NO: 7814
  misc_feature 1..502: note = Synthetic polypeptide
  source 1..502: mol_type = other DNA

SEQ ID NO: 13725 - DNA, 295 bp, synthetic construct; identical to SEQ ID NO: 7815
  misc_feature 1..295: note = Synthetic polypeptide
  source 1..295: mol_type = other DNA

SEQ ID NO: 13726 - DNA, 2502 bp, synthetic construct; identical to SEQ ID NO: 8603
  misc_feature 1..2502: note = Synthetic polypeptide
  source 1..2502: mol_type = other DNA

SEQ ID NO: 13727 - DNA, 441 bp, synthetic construct; identical to SEQ ID NO: 8604
  misc_feature 1..441: note = Synthetic polypeptide
  source 1..441: mol_type = other DNA

SEQ ID NO: 13728 - DNA, 2454 bp, synthetic construct; identical to SEQ ID NO: 8605
  misc_feature 1..2454: note = Synthetic polypeptide
  source 1..2454: mol_type = other DNA

SEQ ID NO: 13729 - DNA, 242 bp, synthetic construct
  misc_feature 1..242: note = Synthetic polypeptide
  source 1..242: mol_type = other DNA
tgaagaaaacatgtcccaccatcagctctgtttcgagatgggcagggctgtctcaggaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtga

SEQ ID NO: 13730 - DNA, 117 bp, synthetic construct
  misc_feature 1..117: note = Synthetic polypeptide
  source 1..117: mol_type = other DNA
ggccaggcatggtggcacacacctgtaatcccagcactttgggaggccaaggagctccagggtcagaggtcggatgtctacagcgacctcaacacacagaggccgtattacaaatga

SEQ ID NO: 13731 - DNA, 675 bp, synthetic construct
  misc_feature 1..675: note = Synthetic polypeptide
  source 1..675: mol_type = other DNA
ccatcttactggtttctgcctaagtatttaaacatgctcagttctcccatgttgaaattcccttctctttgacctcatccactactgccctatctggccattctttcccagccacacttattgcctatgctgtctctccttcactgccttaccctccccttacttcccaatatacagtattgtaatcgagcttctctccctgactaccctggaacttttcttgctaatgtcactggcaaccttcttatagctcagtctaagttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaa

SEQ ID NO: 13732 - DNA, 463 bp, synthetic construct; identical to SEQ ID NO: 803
  misc_feature 1..463: note = Synthetic polypeptide
  source 1..463: mol_type = other DNA

SEQ ID NO: 13733 - DNA, 1241 bp, synthetic construct
  misc_feature 1..1241: note = Synthetic polypeptide
  source 1..1241: mol_type = other DNA
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13734 - DNA, 624 bp, synthetic construct
  misc_feature 1..624: note = Synthetic polypeptide
  source 1..624: mol_type = other DNA
ggccgagcgcggtggctcaggtttgtaaatcccagcactttgggaggccgaggcgggcggatcacctgaggtcaggagtttgagaccagcctggccattgtggtgaaaccccgtctctaacaaaaatacaaaaattagccggccgtagtggcgggcgcctgtaattgcagctattcgggaggctgaggccggaggatcgcttgaacccgggaggcggaggttgcagtgagccgagattgcgccactgcacttccagcctgagcgacagagagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtag

SEQ ID NO: 13735 - DNA, 504 bp, synthetic construct
  misc_feature 1..504: note = Synthetic polypeptide
  source 1..504: mol_type = other DNA
ggccgagcgcggtggctcaggtttgtaaatcccagcactttgggaggccgaggcgggcggatcacctgaggtcaggagtttgagaccagcctggccattgtggtgaaaccccgtctctaacaaaaatacaaaaattagccggccgtagtggcgggcgcctgtaattgcagctattcgggaggctgaggccggaggatcgcttgaacccgggaggcggaggttgcagtgagccgagattgcgccactgcacttccagcctgagcgacagagagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgatagtgcctcccctccctgttccccaccaggcactgcaacatggtgctggagaacgtga

SEQ ID NO: 13736 - DNA, 978 bp, synthetic construct
  misc_feature 1..978: note = Synthetic polypeptide
  source 1..978: mol_type = other DNA
agaaaaagtatgtttttgtacagctatacaatatttatgttttaagctaagtgttattacaaaagagtcaaaattaaaatatttaaaagtttataaagtaaaaaagttacagcaagctaaggttaataaaataattttaaataaatttagtgtagcctaaatgtagtgtttataaaatcaacagtagtgtatagtaatgtcctaggcctttaccttcactcacaactcacccagagcatcttccagtcctctaaggttcatttgtggtgagtgccctatacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 13737 - DNA, 683 bp, synthetic construct
  misc_feature 1..683: note = Synthetic polypeptide
  source 1..683: mol_type = other DNA
agaaaaagtatgtttttgtacagctatacaatatttatgttttaagctaagtgttattacaaaagagtcaaaattaaaatatttaaaagtttataaagtaaaaaagttacagcaagctaaggttaataaaataattttaaataaatttagtgtagcctaaatgtagtgtttataaaatcaacagtagtgtatagtaatgtcctaggcctttaccttcactcacaactcacccagagcatcttccagtcctctaaggttcatttgtggtgagtgccctatacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatt

SEQ ID NO: 13738 - DNA, 405 bp, synthetic construct
  misc_feature 1..405: note = Synthetic polypeptide
  source 1..405: mol_type = other DNA
gagttcaagaccagcccggccaccatgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactag

SEQ ID NO: 13739 - DNA, 534 bp, synthetic construct
  misc_feature 1..534: note = Synthetic polypeptide
  source 1..534: mol_type = other DNA
ggctgggcgcggtagctcacgtctgtaatcccagcactttgggaggctgaggcgggcggatcacgaggtcaggagatcaagaccatcctggataacacggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaa

SEQ ID NO: 13740 - DNA, 433 bp, synthetic construct
  misc_feature 1..433: note = Synthetic polypeptide
  source 1..433: mol_type = other DNA
ggctgggcgcggtagctcacgtctgtaatcccagcactttgggaggctgaggcgggcggatcacgaggtcaggagatcaagaccatcctggataacacggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccc

SEQ ID NO: 13741 - DNA, 346 bp, synthetic construct
  misc_feature 1..346: note = Synthetic polypeptide
  source 1..346: mol_type = other DNA
ggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaattgtggacatcggatacccaaggagacgaagctgaagcaggagaaggaggggaaaattaa

SEQ ID NO: 13742 - DNA, 323 bp, synthetic construct
  misc_feature 1..323: note = Synthetic polypeptide
  source 1..323: mol_type = other DNA
ggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaattgtggacatcggatacccaaggagacgaagctgaag

SEQ ID NO: 13743 - DNA, 767 bp, synthetic construct; identical to SEQ ID NO: 724
  misc_feature 1..767: note = Synthetic polypeptide
  source 1..767: mol_type = other DNA

SEQ ID NO: 13744 - DNA, 2874 bp, synthetic construct
  misc_feature 1..2874: note = Synthetic polypeptide
  source 1..2874: mol_type = other DNA
aaataggaaccctgattagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13745 - DNA, 2844 bp, synthetic construct
  misc_feature 1..2844: note = Synthetic polypeptide
  source 1..2844: mol_type = other DNA
aaataggaaccctgattagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13746 - DNA, 2817 bp, synthetic construct
  misc_feature 1..2817: note = Synthetic polypeptide
  source 1..2817: mol_type = other DNA
aaataggaaccctgattagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13747 - DNA, 758 bp, synthetic construct
  misc_feature 1..758: note = Synthetic polypeptide
  source 1..758: mol_type = other DNA
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaa

SEQ ID NO: 13748 - DNA, 581 bp, synthetic construct
  misc_feature 1..581: note = Synthetic polypeptide
  source 1..581: mol_type = other DNA
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaa

SEQ ID NO: 13749 - DNA, 395 bp, synthetic construct
  misc_feature 1..395: note = Synthetic polypeptide
  source 1..395: mol_type = other DNA
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcagagactgatgccgtgggtgtga

SEQ ID NO: 13750 - DNA, 647 bp, synthetic construct
  misc_feature 1..647: note = Synthetic polypeptide
  source 1..647: mol_type = other DNA
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccaggtggggcctgtttccacttcctgcttcccacaaggccgttctttatacttggggggagttcagccattcaaattgagagtcaaggtcacttcttaa

SEQ ID NO: 13751 - DNA, 382 bp, synthetic construct; identical to SEQ ID NO: 434
  misc_feature 1..382: note = Synthetic polypeptide
  source 1..382: mol_type = other DNA

SEQ ID NO: 13752 - DNA, 347 bp, synthetic construct; identical to SEQ ID NO: 452
  misc_feature 1..347: note = Synthetic polypeptide
  source 1..347: mol_type = other DNA

SEQ ID NO: 13753 - DNA, 148 bp, synthetic construct; identical to SEQ ID NO: 454
  misc_feature 1..148: note = Synthetic polypeptide
  source 1..148: mol_type = other DNA

SEQ ID NO: 13754 - DNA, 336 bp, synthetic construct; identical to SEQ ID NO: 7520
  misc_feature 1..336: note = Synthetic polypeptide
  source 1..336: mol_type = other DNA

SEQ ID NO: 13755 - DNA, 346 bp, synthetic construct; identical to SEQ ID NO: 7521
  misc_feature 1..346: note = Synthetic polypeptide
  source 1..346: mol_type = other DNA

SEQ ID NO: 13756 - DNA, 433 bp, synthetic construct; identical to SEQ ID NO: 8244
  misc_feature 1..433: note = Synthetic polypeptide
  source 1..433: mol_type = other DNA

SEQ ID NO: 13757 - DNA, 433 bp, synthetic construct; identical to SEQ ID NO: 8245
  misc_feature 1..433: note = Synthetic polypeptide
  source 1..433: mol_type = other DNA

SEQ ID NO: 13758 - DNA, 201 bp, synthetic construct; identical to SEQ ID NO: 6463
  misc_feature 1..201: note = Synthetic polypeptide
  source 1..201: mol_type = other DNA

SEQ ID NO: 13759 - DNA, 159 bp, synthetic construct; identical to SEQ ID NO: 6464
  misc_feature 1..159: note = Synthetic polypeptide
  source 1..159: mol_type = other DNA

SEQ ID NO: 13760 - DNA, 116 bp, synthetic construct
  misc_feature 1..116: note = Synthetic polypeptide
  source 1..116: mol_type = other DNA
ttgttaagaggactttttattgtgtacaggggctgtgcagaatggaaaccacacttgcctgtctcccaggaagccagaaactacagggcaacaaggcaccagagtcccggacttag

SEQ ID NO: 13761 - DNA, 282 bp, synthetic construct; identical to SEQ ID NO: 7621
  misc_feature 1..282: note = Synthetic polypeptide
  source 1..282: mol_type = other DNA

SEQ ID NO: 13762 - DNA, 285 bp, synthetic construct; identical to SEQ ID NO: 6477
  misc_feature 1..285: note = Synthetic polypeptide
  source 1..285: mol_type = other DNA

SEQ ID NO: 13763 - DNA, 363 bp, synthetic construct
  misc_feature 1..363: note = Synthetic polypeptide
  source 1..363: mol_type = other DNA
cagtgttgtctgttagaacattctgtgctgatgaaaatgttccatatcggtacaatacagtccagtagccactcagctaccacctgaaatgtggctagtgtcaatgaagaacagaaattgtaactttatgttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctga

SEQ ID NO: 13764 - DNA, 1086 bp, synthetic construct; identical to SEQ ID NO: 444
  misc_feature 1..1086: note = Synthetic polypeptide
  source 1..1086: mol_type = other DNA

SEQ ID NO: 13765 - DNA, 564 bp, synthetic construct; identical to SEQ ID NO: 445
  misc_feature 1..564: note = Synthetic polypeptide
  source 1..564: mol_type = other DNA

SEQ ID NO: 13766 - DNA, 987 bp, synthetic construct; identical to SEQ ID NO: 446
  misc_feature 1..987: note = Synthetic polypeptide
  source 1..987: mol_type = other DNA

SEQ ID NO: 13767 - DNA, 432 bp, synthetic construct; identical to SEQ ID NO: 7545
  misc_feature 1..432: note = Synthetic polypeptide
  source 1..432: mol_type = other DNA

SEQ ID NO: 13768 - DNA, 560 bp, synthetic construct; identical to SEQ ID NO: 6322
  misc_feature 1..560: note = Synthetic polypeptide
  source 1..560: mol_type = other DNA

SEQ ID NO: 13769 - DNA, 116 bp, synthetic construct
  misc_feature 1..116: note = Synthetic polypeptide
  source 1..116: mol_type = other DNA
ttgttaagaggactttttattgtgtccaggggctgtgcagaatggaaaccacgcttgcctgtctcccaggaagccagaaactacagggcaacaaggcaccagagtcccggacttag

SEQ ID NO: 13770 - DNA, 171 bp, synthetic construct; identical to SEQ ID NO: 6873
  misc_feature 1..171: note = Synthetic polypeptide
  source 1..171: mol_type = other DNA

SEQ ID NO: 13771 - DNA, 633 bp, synthetic construct; identical to SEQ ID NO: 6874
  misc_feature 1..633: note = Synthetic polypeptide
  source 1..633: mol_type = other DNA

SEQ ID NO: 13772 - DNA, 636 bp, synthetic construct; identical to SEQ ID NO: 6875
  misc_feature 1..636: note = Synthetic polypeptide
  source 1..636: mol_type = other DNA

SEQ ID NO: 13773 - DNA, 480 bp, synthetic construct; identical to SEQ ID NO: 6876
  misc_feature 1..480: note = Synthetic polypeptide
  source 1..480: mol_type = other DNA

SEQ ID NO: 13774 - DNA, 1325 bp, synthetic construct; identical to SEQ ID NO: 7686
  misc_feature 1..1325: note = Synthetic polypeptide
  source 1..1325: mol_type = other DNA

SEQ ID NO: 13775 - DNA, 1691 bp, synthetic construct; identical to SEQ ID NO: 7687
  misc_feature 1..1691: note = Synthetic polypeptide
  source 1..1691: mol_type = other DNA

SEQ ID NO: 13776 - DNA, 1541 bp, synthetic construct; identical to SEQ ID NO: 7688
  misc_feature 1..1541: note = Synthetic polypeptide
  source 1..1541: mol_type = other DNA

SEQ ID NO: 13777 - DNA, 583 bp, synthetic construct; identical to SEQ ID NO: 7840
  misc_feature 1..583: note = Synthetic polypeptide
  source 1..583: mol_type = other DNA

SEQ ID NO: 13778 - DNA, 1320 bp, synthetic construct; identical to SEQ ID NO: 8817
  misc_feature 1..1320: note = Synthetic polypeptide
  source 1..1320: mol_type = other DNA

SEQ ID NO: 13779 - DNA, 420 bp, synthetic construct; identical to SEQ ID NO: 8818
  misc_feature 1..420: note = Synthetic polypeptide
  source 1..420: mol_type = other DNA

SEQ ID NO: 13780 - DNA, 326 bp, synthetic construct; identical to SEQ ID NO: 6484
  misc_feature 1..326: note = Synthetic polypeptide
  source 1..326: mol_type = other DNA

SEQ ID NO: 13781 - DNA, 146 bp, synthetic construct; identical to SEQ ID NO: 6485
  misc_feature 1..146: note = Synthetic polypeptide
  source 1..146: mol_type = other DNA

SEQ ID NO: 13782 - DNA, 80 bp, synthetic construct; identical to SEQ ID NO: 6364
  misc_feature 1..80: note = Synthetic polypeptide
  source 1..80: mol_type = other DNA

SEQ ID NO: 13783 - DNA, 217 bp, synthetic construct; identical to SEQ ID NO: 6365
  misc_feature 1..217: note = Synthetic polypeptide
  source 1..217: mol_type = other DNA

SEQ ID NO: 13784 - DNA, 2614 bp, synthetic construct; identical to SEQ ID NO: 7559
  misc_feature 1..2614: note = Synthetic polypeptide
  source 1..2614: mol_type = other DNA

SEQ ID NO: 13785 - DNA, 1747 bp, synthetic construct; identical to SEQ ID NO: 7560
  misc_feature 1..1747: note = Synthetic polypeptide
  source 1..1747: mol_type = other DNA

SEQ ID NO: 13786 - DNA, 3021 bp, synthetic construct; identical to SEQ ID NO: 449
  misc_feature 1..3021: note = Synthetic polypeptide
  source 1..3021: mol_type = other DNA

SEQ ID NO: 13787 - DNA, 3075 bp, synthetic construct; identical to SEQ ID NO: 450
  misc_feature 1..3075: note = Synthetic polypeptide
  source 1..3075: mol_type = other DNA

SEQ ID NO: 13788 - DNA, 1143 bp, synthetic construct; identical to SEQ ID NO: 451
  misc_feature 1..1143: note = Synthetic polypeptide
  source 1..1143: mol_type = other DNA

SEQ ID NO: 13789 - DNA, 768 bp, synthetic construct
  misc_feature 1..768: note = Synthetic polypeptide
  source 1..768: mol_type = other DNA
ttttttttttttactatagattgcattaaaatgttttttatcttcatggctgaggttttgggtgcccccttaagttgtgtacctgaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaa

SEQ ID NO: 13790 - DNA, 383 bp, synthetic construct
  misc_feature 1..383: note = Synthetic polypeptide
  source 1..383: mol_type = other DNA
ttttttttttttactatagattgcattaaaatgttttttatcttcatggctgaggttttgggtgcccccttaagttgtgtacctgaggtctccctgcagtacagctccaatggccagtggtaccacacctgcggagggtccctgatagccaacagctgggtcctgacggctgcccactgcatcagacaaattataaaggcccacaaggttctgcaacgttgttcacttatcctcttctttgtccgtgacctctgctcatcacagctggaactcaccggagtttctgccggctcctccgggatctaccgcgtgatgctgggccagcataacctctacgttgcagagtccggctcgctggccgtcagtgtctctaagattgtggt

SEQ ID NO: 13791 - DNA, 1084 bp, synthetic construct
  misc_feature 1..1084: note = Synthetic polypeptide
  source 1..1084: mol_type = other DNA
ttaacaaacgaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttag

SEQ ID NO: 13792 - DNA, 871 bp, synthetic construct; identical to SEQ ID NO: 437
  misc_feature 1..871: note = Synthetic polypeptide
  source 1..871: mol_type = other DNA

SEQ ID NO: 13793 - DNA, 421 bp, synthetic construct; identical to SEQ ID NO: 441
  misc_feature 1..421: note = Synthetic polypeptide
  source 1..421: mol_type = other DNA

SEQ ID NO: 13794 - DNA, 638 bp, synthetic construct; identical to SEQ ID NO: 442
  misc_feature 1..638: note = Synthetic polypeptide
  source 1..638: mol_type = other DNA

SEQ ID NO: 13795 - DNA, 337 bp, synthetic construct; identical to SEQ ID NO: 443
  misc_feature 1..337: note = Synthetic polypeptide
  source 1..337: mol_type = other DNA

SEQ ID NO: 13796 - DNA, 148 bp, synthetic construct; identical to SEQ ID NO: 6388
  misc_feature 1..148: note = Synthetic polypeptide
  source 1..148: mol_type = other DNA

SEQ ID NO: 13797 - DNA, 1100 bp, synthetic construct; identical to SEQ ID NO: 6389
  misc_feature 1..1100: note = Synthetic polypeptide
  source 1..1100: mol_type = other DNA

SEQ ID NO: 13798 - DNA, 464 bp, synthetic construct; identical to SEQ ID NO: 6390
  misc_feature 1..464: note = Synthetic polypeptide
  source 1..464: mol_type = other DNA

SEQ ID NO: 13799 - DNA, 280 bp, synthetic construct; identical to SEQ ID NO: 6391
  misc_feature 1..280: note = Synthetic polypeptide
  source 1..280: mol_type = other DNA

SEQ ID NO: 13800 - DNA, 943 bp, synthetic construct; identical to SEQ ID NO: 9889
  misc_feature 1..943: note = Synthetic polypeptide
  source 1..943: mol_type = other DNA

SEQ ID NO: 13801 - DNA, 387 bp, synthetic construct; identical to SEQ ID NO: 544
  misc_feature 1..387: note = Synthetic polypeptide
  source 1..387: mol_type = other DNA

SEQ ID NO: 13802 - DNA, 540 bp, synthetic construct; identical to SEQ ID NO: 545
  misc_feature 1..540: note = Synthetic polypeptide
  source 1..540: mol_type = other DNA

SEQ ID NO: 13803 - DNA, 303 bp, synthetic construct; identical to SEQ ID NO: 547
  misc_feature 1..303: note = Synthetic polypeptide
  source 1..303: mol_type = other DNA

SEQ ID NO: 13804 - DNA, 2471 bp, synthetic construct; identical to SEQ ID NO: 576
  misc_feature 1..2471: note = Synthetic polypeptide
  source 1..2471: mol_type = other DNA

SEQ ID NO: 13805 - DNA, 653 bp, synthetic construct
  misc_feature 1..653: note = Synthetic polypeptide
  source 1..653: mol_type = other DNA
ttagctacacattaaagcgacctaagacagagtttttgaaaatactgatgcctgtgtcctaccccagggcaattaactcaaacttctcaggaagacagtgtgaataccaccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaa

SEQ ID NO: 13806 - DNA, 406 bp, synthetic construct
  misc_feature 1..406: note = Synthetic polypeptide
  source 1..406: mol_type = other DNA
ttagctacacattaaagcgacctaagacagagtttttgaaaatactgatgcctgtgtcctaccccagggcaattaactcaaacttctcaggaagacagtgtgaataccaccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 13807 - DNA, 1597 bp, synthetic construct
  misc_feature 1..1597: note = Synthetic polypeptide
  source 1..1597: mol_type = other DNA
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13808 - DNA, 1606 bp, synthetic construct
  misc_feature 1..1606: note = Synthetic polypeptide
  source 1..1606: mol_type = other DNA
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13809 - DNA, 376 bp, synthetic construct
  misc_feature 1..376: note = Synthetic polypeptide
  source 1..376: mol_type = other DNA
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgccctt

SEQ ID NO: 13810 - DNA, 1100 bp, synthetic construct
  misc_feature 1..1100: note = Synthetic polypeptide
  source 1..1100: mol_type = other DNA
taaaatcatttataccgtatttttgctgtatgtttttaggtttagatatatttggatacacaactagttacgttgtgttccagttgcctagagtacacagaacagtaacatgctgtacagatttgtagcctaggagcaacaggctgtaccacacagcccagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttag

SEQ ID NO: 13811 - DNA, 117 bp, synthetic construct; identical to SEQ ID NO: 8388
  misc_feature 1..117: note = Synthetic polypeptide
  source 1..117: mol_type = other DNA

SEQ ID NO: 13812 - DNA, 333 bp, synthetic construct; identical to SEQ ID NO: 6583
  misc_feature 1..333: note = Synthetic polypeptide
  source 1..333: mol_type = other DNA

SEQ ID NO: 13813 - DNA, 346 bp, synthetic construct; identical to SEQ ID NO: 7074
  misc_feature 1..346: note = Synthetic polypeptide
  source 1..346: mol_type = other DNA

SEQ ID NO: 13814 - DNA, 470 bp, synthetic construct
  misc_feature 1..470: note = Synthetic polypeptide
  source 1..470: mol_type = other DNA
ctgagacagtgagagtggggaggcctccaaatgcttggcttttcggcccagctctgtcagtcacggtgaaaccttgggcaagccacttccgaacctcagtttcctcatctgtaaaatggaaacactgttggtgaagactaaaagaggtgaaagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaa

SEQ ID NO: 13815 - DNA, 1078 bp, synthetic construct
  misc_feature 1..1078: note = Synthetic polypeptide
  source 1..1078: mol_type = other DNA
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctag

SEQ ID NO: 13816 - DNA, 1213 bp, synthetic construct
  misc_feature 1..1213: note = Synthetic polypeptide
  source 1..1213: mol_type = other DNA
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 13817 - DNA, 1216 bp, synthetic construct
  misc_feature 1..1216: note = Synthetic polypeptide
  source 1..1216: mol_type = other DNA
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 13818 - DNA, 186 bp, synthetic construct
  misc_feature 1..186: note = Synthetic polypeptide
  source 1..186: mol_type = other DNA
ttgttaagaggactttttattgtgtccaggggctgtgcagaatggaaaccacgcttgcctgtctcccaggaagccaggtgaggccgtgcgctgatttctggctgtggcagaagagatgcctacaaatttcaggttgaccatgtaaagaaactacagggcaacaaggcaccagagtcccggacttag

SEQ ID NO: 13819 - DNA, 214 bp, synthetic construct
  misc_feature 1..214: note = Synthetic polypeptide
  source 1..214: mol_type = other DNA
tcttcagagcctggcatggagcctgtcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13820 - DNA, 459 bp, synthetic construct; identical to SEQ ID NO: 6625
  misc_feature 1..459: note = Synthetic polypeptide
  source 1..459: mol_type = other DNA

SEQ ID NO: 13821 - DNA, 571 bp, synthetic construct; identical to SEQ ID NO: 10039
  misc_feature 1..571: note = Synthetic polypeptide
  source 1..571: mol_type = other DNA

SEQ ID NO: 13822 - DNA, 145 bp, synthetic construct
  misc_feature 1..145: note = Synthetic polypeptide
  source 1..145: mol_type = other DNA
ggtggctcacgcctgtaatccaggcactttgggaggtcaagatgggcagatcaccagaggtcaggagttcgagaccagcctggtcaacacggggaaaccccgtctctactaaaaatacaaaaataaggtgattgcaaataactaa

SEQ ID NO: 13823 - DNA, 1775 bp, synthetic construct; identical to SEQ ID NO: 568
  misc_feature 1..1775: note = Synthetic polypeptide
  source 1..1775: mol_type = other DNA

SEQ ID NO: 13824 - DNA, 841 bp, synthetic construct
  misc_feature 1..841: note = Synthetic polypeptide
  source 1..841: mol_type = other DNA
ggccaagtgcggtggctaacgcctgtaatcccagcactttgggaggccgaggaaggtggatcacccgagatcaggagtttgggaccagcctggccaacatggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactga

SEQ ID NO: 13825 - DNA, 524 bp, synthetic construct
  misc_feature 1..524: note = Synthetic polypeptide
  source 1..524: mol_type = other DNA
ggccaagtgcggtggctaacgcctgtaatcccagcactttgggaggccgaggaaggtggatcacccgagatcaggagtttgggaccagcctggccaacatggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggct

SEQ ID NO: 13826 - DNA, 311 bp, synthetic construct
  misc_feature 1..311: note = Synthetic polypeptide
  source 1..311: mol_type = other DNA
gcattagaatcagctggagtgtttataaagcatgcagattcctgatccccagctcatatctaaaaataaaaatatctatggatagggccaggaaatctgcatttttataatgtcatcaagtgattctcagtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaa

SEQ ID NO: 13827 - DNA, 469 bp, synthetic construct
  misc_feature 1..469: note = Synthetic polypeptide
  source 1..469: mol_type = other DNA
ttatcacatttattatttattgtttttctctcccactaggttgtaagctccatgagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttga

SEQ ID NO: 13828 - DNA, 235 bp, synthetic construct
  misc_feature 1..235: note = Synthetic polypeptide
  source 1..235: mol_type = other DNA
ttatcacatttattatttattgtttttctctcccactaggttgtaagctccatgagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagcaaaaacaaagagtgtga

SEQ ID NO: 13829 - DNA, 1130 bp, synthetic construct; identical to SEQ ID NO: 8820
  misc_feature 1..1130: note = Synthetic polypeptide
  source 1..1130: mol_type = other DNA

SEQ ID NO: 13830 - DNA, 1280 bp, synthetic construct; identical to SEQ ID NO: 8821
  misc_feature 1..1280: note = Synthetic polypeptide
  source 1..1280: mol_type = other DNA

SEQ ID NO: 13831 - DNA, 1277 bp, synthetic construct; identical to SEQ ID NO: 8822
  misc_feature 1..1277: note = Synthetic polypeptide
  source 1..1277: mol_type = other DNA

SEQ ID NO: 13832 - DNA, 201 bp, synthetic construct
  misc_feature 1..201: note = Synthetic polypeptide
  source 1..201: mol_type = other DNA
gtgggagccacaccggatgtgagctggaagacctgggctctgcctcctcttggctgcgtggacttgggagggtcactcccctccccgagcctcatcagttccatttatgaagtaggggaccaggagctggagagcctgtcggccattgaagcagagctggagaaagtggcccaccagctgcaggcactacggcggggctga

SEQ ID NO: 13833 - DNA, 181 bp, synthetic construct; identical to SEQ ID NO: 10485
  misc_feature 1..181: note = Synthetic polypeptide
  source 1..181: mol_type = other DNA

SEQ ID NO: 13834 - DNA, 456 bp, synthetic construct; identical to SEQ ID NO: 6649
  misc_feature 1..456: note = Synthetic polypeptide
  source 1..456: mol_type = other DNA

SEQ ID NO: 13835 - DNA, 480 bp, synthetic construct; identical to SEQ ID NO: 6650
  misc_feature 1..480: note = Synthetic polypeptide
  source 1..480: mol_type = other DNA

SEQ ID NO: 13836 - DNA, 186 bp, synthetic construct; identical to SEQ ID NO: 6651
  misc_feature 1..186: note = Synthetic polypeptide
  source 1..186: mol_type = other DNA

SEQ ID NO: 13837 - DNA, 473 bp, synthetic construct
  misc_feature 1..473: note = Synthetic polypeptide
  source 1..473: mol_type = other DNA
tgctgtggtttgagtatttgttccctccagaactcacattgaaatttaattcctaatgtgcaattattgagaggtggggcctttaagaagtgattgggtcatgaatagattaatccattcatagcttaatgggtaaatggattaatggatcatcacgggagaggaactggtggctttataagaggaaaacagacctaagcttagcatgctcagccgacttgtcatgtgatgccctgtgctgcctgatgactctgcagagtctctatgtaaaaagatcagcaagatggtccgcaccagatgtggctccttgaccttggacttcttagttcccatgatggtcgggaaagaggttaaagaagacacgcaagtatgatatcatcaccactccagcagagcgagtggaaatggcgccactaaatgaagaggatgatgaagatgaggactccacagtattcgacatcaaatacaggtaa

SEQ ID NO: 13838 - DNA, 336 bp, synthetic construct; identical to SEQ ID NO: 7520
  misc_feature 1..336: note = Synthetic polypeptide
  source 1..336: mol_type = other DNA

SEQ ID NO: 13839 - DNA, 346 bp, synthetic construct; identical to SEQ ID NO: 7521
  misc_feature 1..346: note = Synthetic polypeptide
  source 1..346: mol_type = other DNA

SEQ ID NO: 13840 - DNA, 2046 bp, synthetic construct; identical to SEQ ID NO: 8788
  misc_feature 1..2046: note = Synthetic polypeptide
  source 1..2046: mol_type = other DNA

SEQ ID NO: 13841 - DNA, 2100 bp, synthetic construct; identical to SEQ ID NO: 8789
  misc_feature 1..2100: note = Synthetic polypeptide
  source 1..2100: mol_type = other DNA

SEQ ID NO: 13842 - DNA, 2124 bp, synthetic construct; identical to SEQ ID NO: 8790
  misc_feature 1..2124: note = Synthetic polypeptide
  source 1..2124: mol_type = other DNA

SEQ ID NO: 13843 - DNA, 2100 bp, synthetic construct; identical to SEQ ID NO: 8791
  misc_feature 1..2100: note = Synthetic polypeptide
  source 1..2100: mol_type = other DNA

SEQ ID NO: 13844 - DNA, 2016 bp, synthetic construct; identical to SEQ ID NO: 8792
  misc_feature 1..2016: note = Synthetic polypeptide
  source 1..2016: mol_type = other DNA

SEQ ID NO: 13845 - DNA, 2124 bp, synthetic construct; identical to SEQ ID NO: 8793
  misc_feature 1..2124: note = Synthetic polypeptide
  source 1..2124: mol_type = other DNA

SEQ ID NO: 13846 - DNA, 2007 bp, synthetic construct; identical to SEQ ID NO: 8794
  misc_feature 1..2007: note = Synthetic polypeptide
  source 1..2007: mol_type = other DNA

SEQ ID NO: 13847 - DNA, 663 bp, synthetic construct; identical to SEQ ID NO: 8795
  misc_feature 1..663: note = Synthetic polypeptide
  source 1..663: mol_type = other DNA

SEQ ID NO: 13848 - DNA, 718 bp, synthetic construct; identical to SEQ ID NO: 12403
  misc_feature 1..718: note = Synthetic polypeptide
  source 1..718: mol_type = other DNA

SEQ ID NO: 13849 - DNA, 616 bp, synthetic construct; identical to SEQ ID NO: 12404
  misc_feature 1..616: note = Synthetic polypeptide
  source 1..616: mol_type = other DNA

SEQ ID NO: 13850 - DNA, 1290 bp, synthetic construct; identical to SEQ ID NO: 6392
  misc_feature 1..1290: note = Synthetic polypeptide
  source 1..1290: mol_type = other DNA

SEQ ID NO: 13851 - DNA, 215 bp, synthetic construct; identical to SEQ ID NO: 10664
  misc_feature 1..215: note = Synthetic polypeptide
  source 1..215: mol_type = other DNA

SEQ ID NO: 13852 - DNA, 188 bp, synthetic construct; identical to SEQ ID NO: 10665
  misc_feature 1..188: note = Synthetic polypeptide
  source 1..188: mol_type = other DNA

SEQ ID NO: 13853 - DNA, 146 bp, synthetic construct; identical to SEQ ID NO: 10666
  misc_feature 1..146: note = Synthetic polypeptide
  source 1..146: mol_type = other DNA

SEQ ID NO: 13854 - DNA, 871 bp, synthetic construct; identical to SEQ ID NO: 437
  misc_feature 1..871: note = Synthetic polypeptide
  source 1..871: mol_type = other DNA

SEQ ID NO: 13855 - DNA, 421 bp, synthetic construct; identical to SEQ ID NO: 441
  misc_feature 1..421: note = Synthetic polypeptide
  source 1..421: mol_type = other DNA

SEQ ID NO: 13856 - DNA, 638 bp, synthetic construct; identical to SEQ ID NO: 442
  misc_feature 1..638: note = Synthetic polypeptide
  source 1..638: mol_type = other DNA

SEQ ID NO: 13857 - DNA, 337 bp, synthetic construct; identical to SEQ ID NO: 443
  misc_feature 1..337: note = Synthetic polypeptide
  source 1..337: mol_type = other DNA

SEQ ID NO: 13858 - DNA, 805 bp, synthetic construct; identical to SEQ ID NO: 8823
  misc_feature 1..805: note = Synthetic polypeptide
  source 1..805: mol_type = other DNA

SEQ ID NO: 13859 - DNA, 1229 bp, synthetic construct
  misc_feature 1..1229: note = Synthetic polypeptide
  source 1..1229: mol_type = other DNA
cctcctgggcttatggagattttgcatggagtaaccccctgcatccagatatcttcccaggactacgcaagatagaggcagaaatcgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactga

SEQ ID NO: 13860 - DNA, 182 bp, synthetic construct
  misc_feature 1..182: note = Synthetic polypeptide
  source 1..182: mol_type = other DNA
cctcctgggcttatggagattttgcatggagtaaccccctgcatccagatatcttcccaggactacgcaagatagaggcagaaatcgtgaggatagcttgttccctgttcaatgggggaccagattcgtgtggatgtgaagcattgtttttgttttgtttttctaatatgttggcgccatga

SEQ ID NO: 13861 - DNA, 188 bp, synthetic construct
  misc_feature 1..188: note = Synthetic polypeptide
  source 1..188: mol_type = other DNA
cctcctgggcttatggagattttgcatggagtaaccccctgcatccagatatcttcccaggactacgcaagatagaggcagaaatcgtgaggatagcttgttccctgttcaatgggggaccagattcgtgtggatgtgtaagtatatgcaaggggcatccaatagccttattttttaggttaaaatag

SEQ ID NO: 13862 - DNA, 376 bp, synthetic construct; identical to SEQ ID NO: 6329
  misc_feature 1..376: note = Synthetic polypeptide
  source 1..376: mol_type = other DNA

SEQ ID NO: 13863 - DNA, 1196 bp, synthetic construct
  misc_feature 1..1196: note = Synthetic polypeptide
  source 1..1196: mol_type = other DNA
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13864 - DNA, 1136 bp, synthetic construct
  misc_feature 1..1136: note = Synthetic polypeptide
  source 1..1136: mol_type = other DNA
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13865 - DNA, 1118 bp, synthetic construct
  misc_feature 1..1118: note = Synthetic polypeptide
  source 1..1118: mol_type = other DNA
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13866 - DNA, 1193 bp, synthetic construct
  misc_feature 1..1193: note = Synthetic polypeptide
  source 1..1193: mol_type = other DNA
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13867 - DNA, 147 bp, synthetic construct; identical to SEQ ID NO: 6327
  misc_feature 1..147: note = Synthetic polypeptide
  source 1..147: mol_type = other DNA

SEQ ID NO: 13868 - DNA, 29 bp, synthetic construct
  misc_feature 1..29: note = Synthetic polypeptide
  source 1..29: mol_type = other DNA
agaccctgagcctaggaaccacagaataa

SEQ ID NO: 13869 - DNA, 546 bp, synthetic construct; identical to SEQ ID NO: 8836
  misc_feature 1..546: note = Synthetic polypeptide
  source 1..546: mol_type = other DNA

SEQ ID NO: 13870 - DNA, 913 bp, synthetic construct
  misc_feature 1..913: note = Synthetic polypeptide
  source 1..913: mol_type = other DNA
atctgtaagaagatgataaggatagtatctgcctcaaagaactgatgtaagggttaattaagcattatatataaagcacttgaaatcgggctcggccctcagtcagcactcagtaaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactag

SEQ ID NO: 13871 - DNA, 169 bp, synthetic construct
  misc_feature 1..169: note = Synthetic polypeptide
  source 1..169: mol_type = other DNA
atctgtaagaagatgataaggatagtatctgcctcaaagaactgatgtaagggttaattaagcattatatataaagcacttgaaatcgggctcggccctcagtcagcactcagtaaaggcaggagaccgggtgatggtgttgaaccggtcagggatgtggcaggaagag

SEQ ID NO: 13872 - DNA, 433 bp, synthetic construct; identical to SEQ ID NO: 10655
  misc_feature 1..433: note = Synthetic polypeptide
  source 1..433: mol_type = other DNA

SEQ ID NO: 13873 - DNA, 2865 bp, synthetic construct
  misc_feature 1..2865: note = Synthetic polypeptide
  source 1..2865: mol_type = other DNA
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaa

SEQ ID NO: 13874 - DNA, 396 bp, synthetic construct
  misc_feature 1..396: note = Synthetic polypeptide
  source 1..396: mol_type = other DNA
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgg

SEQ ID NO: 13875 - DNA, 575 bp, synthetic construct
  misc_feature 1..575: note = Synthetic polypeptide
  source 1..575: mol_type = other DNA
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcat

SEQ ID NO: 13876 - DNA, 1412 bp, synthetic construct
  misc_feature 1..1412: note = Synthetic polypeptide
  source 1..1412: mol_type = other DNA
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctga

SEQ ID NO: 13877 - DNA, 1274 bp, synthetic construct
  misc_feature 1..1274: note = Synthetic polypeptide
  source 1..1274: mol_type = other DNA
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattag

SEQ ID NO: 13878 - DNA, 1289 bp, synthetic construct
  misc_feature 1..1289: note = Synthetic polypeptide
  source 1..1289: mol_type = other DNA
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattag

SEQ ID NO: 13879 - DNA, 691 bp, synthetic construct
  misc_feature 1..691: note = Synthetic polypeptide
  source 1..691: mol_type = other DNA
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaa

SEQ ID NO: 13880 - DNA, 667 bp, synthetic construct
  misc_feature 1..667: note = Synthetic polypeptide
  source 1..667: mol_type = other DNA
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaa

SEQ ID NO: 13881 - DNA, 886 bp, synthetic construct
  misc_feature 1..886: note = Synthetic polypeptide
  source 1..886: mol_type = other DNA
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagtgtctccaatccttccagaagtcaaacatctccacagaccacctctactagtccttcctttcttctctctgtcttcacttttttctactgacccccttcccaccttcccaacgtcacacagaactgtgaagcggcttcctgctcctcttccccaacctggccatggatcaacccctggtgtgcagagctgcgtgctggctcctccagcaaagagcaaatcgcctgtaaaatctacggagcggacagcaaagttgaccctaaactccaagcaccaccctgcacccactgtactctaa

SEQ ID NO: 13882 - DNA, 679 bp, synthetic construct
  misc_feature 1..679: note = Synthetic polypeptide
  source 1..679: mol_type = other DNA
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagcaaagagcaaatcgcctgtaaaatctacggagcggacagcaaagttgaccctaaactccaagcaccaccctgcacccactgtactctaa

SEQ ID NO: 13883 - DNA, 1721 bp, synthetic construct
  misc_feature 1..1721: note = Synthetic polypeptide
  source 1..1721: mol_type = other DNA
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaa

SEQ ID NO: 13884 - DNA, 2249 bp, synthetic construct
  misc_feature 1..2249: note = Synthetic polypeptide
  source 1..2249: mol_type = other DNA
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaa

SEQ ID NO: 13885 - DNA, 341 bp, synthetic construct
  misc_feature 1..341: note = Synthetic polypeptide
  source 1..341: mol_type = other DNA
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcagggtagaagagagaccagaaaaagattttactgagaaggggtctcgtaacatgccgggcctgtctgcagccacgctggcctctctgggtgggacttcctctcggagaggcagcggagacacctccatctccatcgacacc

SEQ ID NO: 13886 - DNA, 2321 bp, synthetic construct
  misc_feature 1..2321: note = Synthetic polypeptide
  source 1..2321: mol_type = other DNA
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaa

SEQ ID NO: 13887 - DNA, 244 bp, synthetic construct; identical to SEQ ID NO: 10605
  misc_feature 1..244: note = Synthetic polypeptide
  source 1..244: mol_type = other DNA

SEQ ID NO: 13888 - DNA, 467 bp, synthetic construct; identical to SEQ ID NO: 10606
  misc_feature 1..467: note = Synthetic polypeptide
  source 1..467: mol_type = other DNA

SEQ ID NO: 13889 - DNA, 1182 bp, synthetic construct
  misc_feature 1..1182: note = Synthetic polypeptide
  source 1..1182: mol_type = other DNA
cagaagaacaaaacaggttctacagtcacttcagtatatcatttacaatgtgcaaaaagtttcagagatgcaaactaaaatgagaaagtatgaccaatactctgaaaaaaataagttaatagaaaccgattcaagtaggtccagatgttggatttagcagccaaagactgcaaagccactattacaaatacattcaaaggcttaagaaaaatgtattcaatgaattaaaagaaaacatggtatccatgagtgaagagctatggaatctcagcagagaaatagaaacactccagcccccacggaaattctagagctgaaaagtataataaatgaaatgaaaatcatttaaatgtactcaacaacaattttgagatgaaaacagaacatttgaacagaaaatgcagtgaatttgaagatagatcaagagagaatagttaatcaaaagaacaggagccaaaaagattgaaaaataaccaaagtcacagacctatgtaacattaagtagttcaacacatgcataattttagtattagatgtaatgaaaaaaagaacattaccgaaaaaatattgaagaaatgttggccaaaaatttctcaagtttgataaaagctactaacttagagatccgctaagctcaacaaatccaactgagtgaagcccaaagaaaaccaaagcaaggaacattatagtcacaacggtaaaatcaaagattaagagaaaatcttgaaaataagagaaaaaaatgatgtgctatataaacatctgacttcccaacataaatagtggaaattatcagacactggaatgattattcaaagtgctgaagaagaaaaatcaacaattctctatttaatgaaactatctttttaaaatggaggccaaaaatacattttccagatcaacaaaatctaagataatttgttggtaacaggtttatacttcaagatggacaagaagttctatcagctgctgagaaatgatgccagatggtaactcagatatacaagaaatactcaaatgtgctggaaatggcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactga

SEQ ID NO: 13890 - DNA, 769 bp, synthetic construct; identical to SEQ ID NO: 6486
  misc_feature 1..769: note = Synthetic polypeptide
  source 1..769: mol_type = other DNA

SEQ ID NO: 13891 - DNA, 941 bp, synthetic construct
  misc_feature 1..941: note = Synthetic polypeptide
  source 1..941: mol_type = other DNA
cagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttga

SEQ ID NO: 13892 - DNA, 320 bp, synthetic construct
  misc_feature 1..320: note = Synthetic polypeptide
  source 1..320: mol_type = other DNA
cagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctga

SEQ ID NO: 13893 - DNA, 173 bp, synthetic construct; identical to SEQ ID NO: 10896
  misc_feature 1..173: note = Synthetic polypeptide
  source 1..173: mol_type = other DNA

SEQ ID NO: 13894 - DNA, 159 bp, synthetic construct; identical to SEQ ID NO: 10897
  misc_feature 1..159: note = Synthetic polypeptide
  source 1..159: mol_type = other DNA

SEQ ID NO: 13895 - DNA, 357 bp, synthetic construct; identical to SEQ ID NO: 10751
  misc_feature 1..357: note = Synthetic polypeptide
  source 1..357: mol_type = other DNA

SEQ ID NO: 13896 - DNA, 516 bp, synthetic construct
  misc_feature 1..516: note = Synthetic polypeptide
  source 1..516: mol_type = other DNA
gctgagcatagagagactcaggtgacaatcagaaaagagagagctgaggccattgaccatggctggcttgggcattctctgcctatatgccttgtacaatcactctgcctcaccaagcctgattcctcatttgtaaaatcgacatcatgatacccactcccagaagttgttcttcccaatggcataggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtga

SEQ ID NO: 13897 - DNA, 446 bp, synthetic construct
  misc_feature 1..446: note = Synthetic polypeptide
  source 1..446: mol_type = other DNA
gctgagcatagagagactcaggtgacaatcagaaaagagagagctgaggccattgaccatggctggcttgggcattctctgcctatatgccttgtacaatcactctgcctcaccaagcctgattcctcatttgtaaaatcgacatcatgatacccactcccagaagttgttcttcccaatggcataggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaa

SEQ ID NO: 13898 - DNA, 560 bp, synthetic construct; identical to SEQ ID NO: 6321
  misc_feature 1..560: note = Synthetic polypeptide
  source 1..560: mol_type = other DNA

SEQ ID NO: 13899 - DNA, 271 bp, synthetic construct; identical to SEQ ID NO: 8953
  misc_feature 1..271: note = Synthetic polypeptide
  source 1..271: mol_type = other DNA

SEQ ID NO: 13900 - DNA, 60 bp, synthetic construct; identical to SEQ ID NO: 8954
  misc_feature 1..60: note = Synthetic polypeptide
  source 1..60: mol_type = other DNA

SEQ ID NO: 13901 - DNA, 808 bp, synthetic construct
  misc_feature 1..808: note = Synthetic polypeptide
  source 1..808: mol_type = other DNA
gcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctag

SEQ ID NO: 13902 - DNA, 790 bp, synthetic construct
  misc_feature 1..790: note = Synthetic polypeptide
  source 1..790: mol_type = other DNA
gcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagggtcttgctatgttgccaggctggtctcaaaattcctggactcaagcaatcctcctatgttggcctcccaaagtgctgggattacagacatga

SEQ ID NO: 13903 - DNA, 947 bp, synthetic construct; identical to SEQ ID NO: 6434
  misc_feature 1..947: note = Synthetic polypeptide
  source 1..947: mol_type = other DNA

SEQ ID NO: 13904 - DNA, 881 bp, synthetic construct; identical to SEQ ID NO: 6435
  misc_feature 1..881: note = Synthetic polypeptide
  source 1..881: mol_type = other DNA

SEQ ID NO: 13905 - DNA, 7248 bp, synthetic construct
  misc_feature 1..7248: note = Synthetic polypeptide
  source 1..7248: mol_type = other DNA
ttaacagaaacaatggaagccaaaagaaagaaaacaactgccacctagaattctctactcaatacgtatatcttttaataaggaaggtgaaataaaactattttcaggaaataaaaattaagggaatttgtcaccagcagactctcactaaaggaaaaactaaaaaggagttcttcaggcagaaggaaaatgattcccgatggaagctcagagatacaggaagtaatgaagaacagtggaaagcatttgttcagtgctcagcacaggagtttgaccagacagagtagacgtcaaatatgtaccagtagtttgatggaacgtttcttacaggatgtactgcagcaccacccatatcattgtcaagagagcagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatag

SEQ ID NO: 13906 - DNA, 310 bp, synthetic construct
  misc_feature 1..310: note = Synthetic polypeptide
  source 1..310: mol_type = other DNA
ggccgggcatggtggctgacacctggaataccagcacttggggaggccgagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13907 - DNA, 189 bp, synthetic construct
  misc_feature 1..189: note = Synthetic polypeptide
  source 1..189: mol_type = other DNA
ggccgggcatggtggctgacacctggaataccagcacttggggaggccgagggatggccagtcaggaaagataaccgtggatgactatggagccagaacaggcaaatccccaggcatgatgcggcagcttaacatcaatggagctctgtatgtgggtggaatgaaggaaattgctctgcacactaacag

SEQ ID NO: 13908 - DNA, 158 bp, synthetic construct; identical to SEQ ID NO: 7602
  misc_feature 1..158: note = Synthetic polypeptide
  source 1..158: mol_type = other DNA

SEQ ID NO: 13909 - DNA, 570 bp, synthetic construct
  misc_feature 1..570: note = Synthetic polypeptide
  source 1..570: mol_type = other DNA
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtag

SEQ ID NO: 13910 - DNA, 411 bp, synthetic construct
  misc_feature 1..411: note = Synthetic polypeptide
  source 1..411: mol_type = other DNA
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggctattctgagtcaggactgccccatggagacccggatgtatgcaacccagaagcccacgaaggaatttcctctgggggaggacagtga

SEQ ID NO: 13911 - DNA, 150 bp, synthetic construct
  misc_feature 1..150: note = Synthetic polypeptide
  source 1..150: mol_type = other DNA
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtctaccaagttag

SEQ ID NO: 13912 - DNA, 701 bp, synthetic construct
  misc_feature 1..701: note = Synthetic polypeptide
  source 1..701: mol_type = other DNA
ggctacctacaaagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13913 - DNA, 599 bp, synthetic construct
  misc_feature 1..599: note = Synthetic polypeptide
  source 1..599: mol_type = other DNA
ggctacctacaaagatcatcttcttcctgggaaccacggccctggccttcctggtgctcatgcctgtgctccatggcaggaacctcctgctcttccgttccctggagtcctcgtgaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcaca

SEQ ID NO: 13914 - DNA, 4420 bp, synthetic construct
  misc_feature 1..4420: note = Synthetic polypeptide
  source 1..4420: mol_type = other DNA
cagaatctaaagctagcattaaggaacactgagaaccttcagatttaccctttggaattcccataaattctcagagtttggtaccaagtacttctggaagtagaagataaaagagaagataaagaagactgattgaaagtatgattgagaagtgtcagcattccatatctctttccaatgtctgcatagccaggcaatcccctccctcttcccaaaagactagttaaaagcaaaaggtctgtgaacagggggcatccatcacaattggagatatgggtaccatactgaaaagtatatatacatgggatgcggagacctcagtcttcttccctgctcagttcccctatttaggtcagacttgttcctttaggtaggatattgaaagatcttccctgggatgtgaccagcctaagaagaaaaacataatgatattgatattgaaaactctcaaaacagctacagtaaagttcacagtcaagaatccccactcacacacacaaagtttacaatgagttttttattcatgaacacttaaatatgagcagataatcaaggattcctaagcatctaaacagtgcctctaacatgaaagataaaagccaacaccagaaagtcgaaatatcttggaggaaatagagaccatgaagaaaaatgtaacagaaacacaccaaaaaaacagtattcacttagatccctagacagataaaatactacaactgtaaacatgagcaggatagtatataaaagtaaatgaataataacaaaagggcaaaaagagccttgggattttaataatatgatatcagaaatggaaaactcacttaaggattaaaaggaaatttggagaaatcttttggaaagtagaacaaaaaaataaagagatggcaaaaaggagagaaaagaaaattagtgcctcaattcaggacataaactgtacaaataacaggcattctacaaaggaagaaaagagaaaaaaccaaggagatattaccaataaaatagttcagagatacaaaaagatgaaaatagaccaaagccaggaaatgaaaagaaaatgctacaaaattccagaaagtaaaaacaaaaacaagaaaagtcaagaatcaaaatggctttggacttaccatcaatactggcagcaagaagattgcagggcaattacttcaaaattctgaaggaaaattatttctaacctagaattccatacccagccaaactatcaatgaaggatgatagaagactcttactacatttacctcctttacatcttttctcaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13915 - DNA, 4396 bp, synthetic construct
  misc_feature 1..4396: note = Synthetic polypeptide
  source 1..4396: mol_type = other DNA
cagaatctaaagctagcattaaggaacactgagaaccttcagatttaccctttggaattcccataaattctcagagtttggtaccaagtacttctggaagtagaagataaaagagaagataaagaagactgattgaaagtatgattgagaagtgtcagcattccatatctctttccaatgtctgcatagccaggcaatcccctccctcttcccaaaagactagttaaaagcaaaaggtctgtgaacagggggcatccatcacaattggagatatgggtaccatactgaaaagtatatatacatgggatgcggagacctcagtcttcttccctgctcagttcccctatttaggtcagacttgttcctttaggtaggatattgaaagatcttccctgggatgtgaccagcctaagaagaaaaacataatgatattgatattgaaaactctcaaaacagctacagtaaagttcacagtcaagaatccccactcacacacacaaagtttacaatgagttttttattcatgaacacttaaatatgagcagataatcaaggattcctaagcatctaaacagtgcctctaacatgaaagataaaagccaacaccagaaagtcgaaatatcttggaggaaatagagaccatgaagaaaaatgtaacagaaacacaccaaaaaaacagtattcacttagatccctagacagataaaatactacaactgtaaacatgagcaggatagtatataaaagtaaatgaataataacaaaagggcaaaaagagccttgggattttaataatatgatatcagaaatggaaaactcacttaaggattaaaaggaaatttggagaaatcttttggaaagtagaacaaaaaaataaagagatggcaaaaaggagagaaaagaaaattagtgcctcaattcaggacataaactgtacaaataacaggcattctacaaaggaagaaaagagaaaaaaccaaggagatattaccaataaaatagttcagagatacaaaaagatgaaaatagaccaaagccaggaaatgaaaagaaaatgctacaaaattccagaaagtaaaaacaaaaacaagaaaagtcaagaatcaaaatggctttggacttaccatcaatactggcagcaagaagattgcagggcaattacttcaaaattctgaaggaaaattatttctaacctagaattccatacccagccaaactatcaatgaaggatgatagaagactcttactacatttacctcctttacatcttttctcaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13916 - DNA, 378 bp, synthetic construct
  misc_feature 1..378: note = Synthetic polypeptide
  source 1..378: mol_type = other DNA
aacaacagaataaaccaaacaaaatagaaaaaaggagataatacaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactga

SEQ ID NO: 13917 - DNA, 112 bp, synthetic construct
  misc_feature 1..112: note = Synthetic polypeptide
  source 1..112: mol_type = other DNA
aacaacagaataaaccaaacaaaatagaaaaaaggagataatacaggaatgggaaaaggacagcacaggatgccctccaaggatgagctggtccagagatacaacaggatga

SEQ ID NO: 13918 - DNA, 86 bp, synthetic construct
  misc_feature 1..86: note = Synthetic polypeptide
  source 1..86: mol_type = other DNA
aacaacagaataaaccaaacaaaatagaaaaaaggagataatacaggaatgggaaaaggacagcacaggatgccctccaaggatga

SEQ ID NO: 13919 - DNA, 141 bp, synthetic construct
  misc_feature 1..141: note = Synthetic polypeptide
  source 1..141: mol_type = other DNA
aacaacagaataaaccaaacaaaatagaaaaaaggagataatacaggaatgggaaaaggacagcacaggatgccctccaaggatgagctggtccagagatacaacaggatgaataccatcccccagacccgatccattcag

SEQ ID NO: 13920 - DNA, 305 bp, synthetic construct
  misc_feature 1..305: note = Synthetic polypeptide
  source 1..305: mol_type = other DNA
tgttggtgatttgcactggaccccgagctctttgagagcaggcctgcgcttacccactctatccagcaccaagcaatcactcggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctga

SEQ ID NO: 13921 - DNA, 391 bp, synthetic construct
  misc_feature 1..391: note = Synthetic polypeptide
  source 1..391: mol_type = other DNA
tgttggtgatttgcactggaccccgagctctttgagagcaggcctgcgcttacccactctatccagcaccaagcaatcactcggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatga

SEQ ID NO: 13922 - DNA, 756 bp, synthetic construct; identical to SEQ ID NO: 8739
  misc_feature 1..756: note = Synthetic polypeptide
  source 1..756: mol_type = other DNA

SEQ ID NO: 13923 - DNA, 1739 bp, synthetic construct
  misc_feature 1..1739: note = Synthetic polypeptide
  source 1..1739: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13924 - DNA, 1874 bp, synthetic construct
  misc_feature 1..1874: note = Synthetic polypeptide
  source 1..1874: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13925 - DNA, 1826 bp, synthetic construct
  misc_feature 1..1826: note = Synthetic polypeptide
  source 1..1826: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13926 - DNA, 1787 bp, synthetic construct
  misc_feature 1..1787: note = Synthetic polypeptide
  source 1..1787: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13927 - DNA, 398 bp, synthetic construct
  misc_feature 1..398: note = Synthetic polypeptide
  source 1..398: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtgtga

SEQ ID NO: 13928 - DNA, 278 bp, synthetic construct
  misc_feature 1..278: note = Synthetic polypeptide
  source 1..278: mol_type = other DNA
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaag

SEQ ID NO: 13929 - DNA, 1272 bp, synthetic construct; identical to SEQ ID NO: 10519
  misc_feature 1..1272: note = Synthetic polypeptide
  source 1..1272: mol_type = other DNA

SEQ ID NO: 13930 - DNA, 1572 bp, synthetic construct
  misc_feature 1..1572: note = Synthetic polypeptide
  source 1..1572: mol_type = other DNA
ccctgctgctaactcactggctgaatttagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatga

SEQ ID NO: 13931 - DNA, 1464 bp, synthetic construct
  misc_feature 1..1464: note = Synthetic polypeptide
  source 1..1464: mol_type = other DNA
ccctgctgctaactcactggctgaatttagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaactcccttttcctcaactcagtgaggccaggatttgctctccaaaaggctttgctagtgtgttcaatgggacctgctgtggggagtcctaa

SEQ ID NO: 13932 - DNA, 788 bp, synthetic construct
  misc_feature 1..788: note = Synthetic polypeptide
  source 1..788: mol_type = other DNA
ccatcttatcccaaaagtcttatctttctccgttgcgttcatctccacaggccatacagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13933 - DNA, 149 bp, synthetic construct
  misc_feature 1..149: note = Synthetic polypeptide
  source 1..149: mol_type = other DNA
ccatcttatcccaaaagtcttatctttctccgttgcgttcatctccacaggccatacagatggttgccaccctggggaccacaacatgctgctcctttgacaatctcttagaagtcggtcctatcttttgcagattcattcaactttaa

SEQ ID NO: 13934 - DNA, 362 bp, synthetic construct
  misc_feature 1..362: note = Synthetic polypeptide
  source 1..362: mol_type = other DNA
ccatcttatcccaaaagtcttatctttctccgttgcgttcatctccacaggccatacagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttga

SEQ ID NO: 13935 - DNA, 1117 bp, synthetic construct
  misc_feature 1..1117: note = Synthetic polypeptide
  source 1..1117: mol_type = other DNA
aggcagccatgtgtcagtgcaaagagatcccgagcttgtcatttggaggcttgggttccaggctcagctctgctgcccgcaaactgtgagatggacagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctga

SEQ ID NO: 13936 - DNA, 611 bp, synthetic construct; identical to SEQ ID NO: 9528
  misc_feature 1..611: note = Synthetic polypeptide
  source 1..611: mol_type = other DNA

SEQ ID NO: 13937 - DNA, 578 bp, synthetic construct; identical to SEQ ID NO: 9529
  misc_feature 1..578: note = Synthetic polypeptide
  source 1..578: mol_type = other DNA

SEQ ID NO: 13938 - DNA, 293 bp, synthetic construct; identical to SEQ ID NO: 9530
  misc_feature 1..293: note = Synthetic polypeptide
  source 1..293: mol_type = other DNA

SEQ ID NO: 13939 - DNA, 2142 bp, synthetic construct
  misc_feature 1..2142: note = Synthetic polypeptide
  source 1..2142: mol_type = other DNA
ggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacaggctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtga

SEQ ID NO: 13940 - DNA, 726 bp, synthetic construct
  misc_feature 1..726: note = Synthetic polypeptide
  source 1..726: mol_type = other DNA
ggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacaggctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatga

SEQ ID NO: 13941 - DNA, 512 bp, synthetic construct
  misc_feature 1..512: note = Synthetic polypeptide
  source 1..512: mol_type = other DNA
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaa

SEQ ID NO: 13942 - DNA, 347 bp, synthetic construct
  misc_feature 1..347: note = Synthetic polypeptide
  source 1..347: mol_type = other DNA
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcacgcactgcctccttacctgtgaggaatgcaaaataa

SEQ ID NO: 13943 - DNA, 312 bp, synthetic construct
  misc_feature 1..312: note = Synthetic polypeptide
  source 1..312: mol_type = other DNA
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcac

SEQ ID NO: 13944 - DNA, 819 bp, synthetic construct
  misc_feature 1..819: note = Synthetic polypeptide
  source 1..819: mol_type = other DNA
cccagattagctcctggcttgaacttgtaccacccttacctgaaaattggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13945 - DNA, 239 bp, synthetic construct
  misc_feature 1..239: note = Synthetic polypeptide
  source 1..239: mol_type = other DNA
cccagattagctcctggcttgaacttgtaccacccttacctgaaaattggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13946 - DNA, 739 bp, synthetic construct
  misc_feature 1..739: note = Synthetic polypeptide
  source 1..739: mol_type = other DNA
ggccaggcgcggtggctcatgcctgtaatcccagcactttgggaggccaaggcgggtggatcacttgaggtcaagagttcaagaccagcctaaccaacatgtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctag

SEQ ID NO: 13947 - DNA, 319 bp, synthetic construct
  misc_feature 1..319: note = Synthetic polypeptide
  source 1..319: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 13948 - DNA, 310 bp, synthetic construct
  misc_feature 1..310: note = Synthetic polypeptide
  source 1..310: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 13949 - DNA, 3565 bp, synthetic construct
  misc_feature 1..3565: note = Synthetic polypeptide
  source 1..3565: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactga

SEQ ID NO: 13950 - DNA, 3544 bp, synthetic construct
  misc_feature 1..3544: note = Synthetic polypeptide
  source 1..3544: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 13951 - DNA, 224 bp, synthetic construct
  misc_feature 1..224: note = Synthetic polypeptide
  source 1..224: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 13952 - DNA, 159 bp, synthetic construct
  misc_feature 1..159: note = Synthetic polypeptide
  source 1..159: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgct

SEQ ID NO: 13953 - DNA, 3508 bp, synthetic construct
  misc_feature 1..3508: note = Synthetic polypeptide
  source 1..3508: mol_type = other DNA
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 13954 - DNA, 1553 bp, synthetic construct
  misc_feature 1..1553: note = Synthetic polypeptide
  source 1..1553: mol_type = other DNA
gcagaggaaggaatgaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 13955 - DNA, 448 bp, synthetic construct
  misc_feature 1..448: note = Synthetic polypeptide
  source 1..448: mol_type = other DNA
gcagaggaaggaatgaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggagga

SEQ ID NO: 13956 - DNA, 244 bp, synthetic construct
  misc_feature 1..244: note = Synthetic polypeptide
  source 1..244: mol_type = other DNA
ggccgggcacagtggctcgtacctgcaatcccagcactttggaagggcaaagcgggtggatcacttgagcccaggagttaaagaccagcctgggcaacacaggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctga

SEQ ID NO: 13957 - DNA, 204 bp, synthetic construct
  misc_feature 1..204: note = Synthetic polypeptide
  source 1..204: mol_type = other DNA
gcccggggggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 13958 - DNA, 1900 bp, synthetic construct
  misc_feature 1..1900: note = Synthetic polypeptide
  source 1..1900: mol_type = other DNA
taagagcctggagctggacagacttgctttcacccccagttttgcaacttgctaaccagctgcatgatcttactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctag

SEQ ID NO: 13959 - DNA, 139 bp, synthetic construct
  misc_feature 1..139: note = Synthetic polypeptide
  source 1..139: mol_type = other DNA
gggctttggagtcgggctgctgggttctgttctgtcttctagccgccggtgtggctgggtcatgttgcttaacttatgggtctgctttctcatctctaaagctggagccagacatcctgcttcgggccaagcaagattt

SEQ ID NO: 13960 - DNA, 2225 bp, synthetic construct
  misc_feature 1..2225: note = Synthetic polypeptide
  source 1..2225: mol_type = other DNA
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 13961 - DNA, 200 bp, synthetic construct
  misc_feature 1..200: note = Synthetic polypeptide
  source 1..200: mol_type = other DNA
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggt

SEQ ID NO: 13962 - DNA, 2258 bp, synthetic construct
  misc_feature 1..2258: note = Synthetic polypeptide
  source 1..2258: mol_type = other DNA
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtcagagcccagcaggcagccaggcgggcgggcgagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 13963 - DNA, 269 bp, synthetic construct
  misc_feature 1..269: note = Synthetic polypeptide
  source 1..269: mol_type = other DNA
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggag

SEQ ID NO: 13964 - DNA, 1058 bp, synthetic construct
  misc_feature 1..1058: note = Synthetic polypeptide
  source 1..1058: mol_type = other DNA
attctggagttcagccatctgggcttgatttcctcctctcctgtattcatcacatgaactaggtgagttgctgcactgctcccaggactcagttttctcatctgtaaaatggaggcaatctggacggaacaaggaggctgtaagaatccagcaagggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaa

SEQ ID NO: 13965 - DNA, 456 bp, synthetic construct; identical to SEQ ID NO: 9037
  misc_feature 1..456: note = Synthetic polypeptide
  source 1..456: mol_type = other DNA

SEQ ID NO: 13966 - DNA, 162 bp, synthetic construct
  misc_feature 1..162: note = Synthetic polypeptide
  source 1..162: mol_type = other DNA
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgt

SEQ ID NO: 13967 - DNA, 1023 bp, synthetic construct
  misc_feature 1..1023: note = Synthetic polypeptide
  source 1..1023: mol_type = other DNA
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaa

SEQ ID NO: 13968 - DNA, 804 bp, synthetic construct
  misc_feature 1..804: note = Synthetic polypeptide
  source 1..804: mol_type = other DNA
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaa

SEQ ID NO: 13969 - DNA, 732 bp, synthetic construct
  misc_feature 1..732: note = Synthetic polypeptide
  source 1..732: mol_type = other DNA
gtggtggctcacacctgtaatcccagcactttgggaagctgaggtaggaggatcgcctgaagtcaggaattcaagatcagcctggacaacatggtgaagctccgtctctactaaaaatacaaaaattagccaggcatggtggcacgtacctgtagtcccagcaactcaggaggtgaaggcaggagaatagtttgaagcggggaggcagaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtga

SEQ ID NO: 13970 - DNA, 626 bp, synthetic construct
  misc_feature 1..626: note = Synthetic polypeptide
  source 1..626: mol_type = other DNA
ccatcttatcccaaaagtcttatctttctccgttgcgttcatctccacaggccatacagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13971 - DNA, 82 bp, synthetic construct
  misc_feature 1..82: note = Synthetic polypeptide
  source 1..82: mol_type = other DNA
ccatcttatcccaaaagtcttatctttctccgttgcgttcatctccacaggccatacagtttgcagattcattcaactttaa

SEQ ID NO: 13972 - DNA, 200 bp, synthetic construct
  misc_feature 1..200: note = Synthetic polypeptide
  source 1..200: mol_type = other DNA
ccatcttatcccaaaagtcttatctttctccgttgcgttcatctccacaggccatacagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttga

SEQ ID NO: 13973 - DNA, 1163 bp, synthetic construct
  misc_feature 1..1163: note = Synthetic polypeptide
  source 1..1163: mol_type = other DNA
gactgggcacggtggttcacccctgtaatcccagcactttgagaggccgaggcacgtggatcacttgagacttttcccttgttttattgataaaaggaggggccctctctggaacagatacctaccagtctttggtcaataaaactttcggctttccagggtatctgctcctctctgttcttcagtttttgtatccttttatagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatga

SEQ ID NO: 13974 - DNA, 1229 bp, synthetic construct
  misc_feature 1..1229: note = Synthetic polypeptide
  source 1..1229: mol_type = other DNA
gactgggcacggtggttcacccctgtaatcccagcactttgagaggccgaggcacgtggatcacttgagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatga

SEQ ID NO: 13975 - DNA, 922 bp, synthetic construct
  misc_feature 1..922: note = Synthetic polypeptide
  source 1..922: mol_type = other DNA
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13976 - DNA, 342 bp, synthetic construct
  misc_feature 1..342: note = Synthetic polypeptide
  source 1..342: mol_type = other DNA
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13977 - DNA, 646 bp, synthetic construct; identical to SEQ ID NO: 7772
  misc_feature 1..646: note = Synthetic polypeptide
  source 1..646: mol_type = other DNA

SEQ ID NO: 13978 - DNA, 304 bp, synthetic construct; identical to SEQ ID NO: 7773
  misc_feature 1..304: note = Synthetic polypeptide
  source 1..304: mol_type = other DNA

SEQ ID NO: 13979 - DNA, 619 bp, synthetic construct; identical to SEQ ID NO: 7774
  misc_feature 1..619: note = Synthetic polypeptide
  source 1..619: mol_type = other DNA

SEQ ID NO: 13980 - DNA, 523 bp, synthetic construct; identical to SEQ ID NO: 7775
  misc_feature 1..523: note = Synthetic polypeptide
  source 1..523: mol_type = other DNA

SEQ ID NO: 13981 - DNA, 441 bp, synthetic construct; identical to SEQ ID NO: 7776
  misc_feature 1..441: note = Synthetic polypeptide
  source 1..441: mol_type = other DNA

SEQ ID NO: 13982 - DNA, 167 bp, synthetic construct; identical to SEQ ID NO: 7777
  misc_feature 1..167: note = Synthetic polypeptide
  source 1..167: mol_type = other DNA

SEQ ID NO: 13983 - DNA, 985 bp, synthetic construct
  misc_feature 1..985: note = Synthetic polypeptide
  source 1..985: mol_type = other DNA
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcaggttagaaaatggaataaatgatcctgcttctataaaaggatgcatatgtgttttaggaagaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13984 - DNA, 405 bp, synthetic construct
  misc_feature 1..405: note = Synthetic polypeptide
  source 1..405: mol_type = other DNA
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcaggttagaaaatggaataaatgatcctgcttctataaaaggatgcatatgtgttttaggaagaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13985 - DNA, 1251 bp, synthetic construct
  misc_feature 1..1251: note = Synthetic polypeptide
  source 1..1251: mol_type = other DNA
gatcatggttttattctccttaaatctctttgatactttcccactgtctttagcataaatctcagatcctaacaccacccacaacgcttttcaatacctggcttcttgtgatgtctccagtctaatcttttaccctccttcccctcagcctctctgctttagtgaactttgttctagtttcttgaagaagttcatcaattcaagcttttgtgcatggtatttcctaaacctgaaatgtgcttcccccgttttgcccaaacagacacagagtctccactccgccccctggttcacacctgcttaacctgccaagtcacatctgaactgtcacccttcagaaggtcctcctctggcaccctaatgtaattgagatcatcctattactctgtgttctggaactccacacttcagacatttctcattcctgtctaagctcttgtgtgtttggtttttggcctcacttttactgctctttaagctcccccagcggagtggagaggtctgttttcccgtgtttggattcccagaggcagtgcaagcctggcacaagcacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctga

SEQ ID NO: 13986 - DNA, 343 bp, synthetic construct; identical to SEQ ID NO: 891
  misc_feature 1..343: note = Synthetic polypeptide
  source 1..343: mol_type = other DNA

SEQ ID NO: 13987 - DNA, 599 bp, synthetic construct; identical to SEQ ID NO: 10783
  misc_feature 1..599: note = Synthetic polypeptide
  source 1..599: mol_type = other DNA

SEQ ID NO: 13988 - DNA, 82 bp, synthetic construct; identical to SEQ ID NO: 10784
  misc_feature 1..82: note = Synthetic polypeptide
  source 1..82: mol_type = other DNA

SEQ ID NO: 13989 - DNA, 1951 bp, synthetic construct
  misc_feature 1..1951: note = Synthetic polypeptide
  source 1..1951: mol_type = other DNA
tttgccaaaaatggctgcaagaatgtttctggttctatgtgatgtaccagaacttgcactttcttcatcaagaagtcaagtctctgtctcctgctcgtgagactagtcaggcttttgtgactgcctcagctattagattatggcagaagtaatgctgtgtgacttctcagccaaagtcctaagagcagaacagcttctgcctggatctctcactctagctatcatgaagcttctctattacatggagatagagatctgctgaaggagccccagctgttggtattttccaggccaggcaccagtcatatgagtaagccagccatcagacaacttagccccagccactgtctgcctgcaactgcacaagagagctgagtgaaaacaatcttgctgagttcagtcaagctccagaaatgtacggggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtacctagtagatgaaatcaagaaaagagaaggattcaagttactgatggaacctgaatatgccaatatttgcttttggtacattccaccgagcctcagagagatggaagaaggacccgagttctgggcaaaacttaatttggtggccccagccattaaggagaggatgatgaagaagggaagcttgatgctgggctaccagccgcaccggggaaaggtcaacttcttccgccaggtggtgatcagccctcaagtgagccgggaggacatggacttcctcctggatgagatagacttactgggtaaagacatgtag

SEQ ID NO: 13990 - DNA, 1642 bp, synthetic construct
  misc_feature 1..1642: note = Synthetic polypeptide
  source 1..1642: mol_type = other DNA
tttgccaaaaatggctgcaagaatgtttctggttctatgtgatgtaccagaacttgcactttcttcatcaagaagtcaagtctctgtctcctgctcgtgagactagtcaggcttttgtgactgcctcagctattagattatggcagaagtaatgctgtgtgacttctcagccaaagtcctaagagcagaacagcttctgcctggatctctcactctagctatcatgaagcttctctattacatggagatagagatctgctgaaggagccccagctgttggtattttccaggccaggcaccagtcatatgagtaagccagccatcagacaacttagccccagccactgtctgcctgcaactgcacaagagagctgagtgaaaacaatcttgctgagttcagtcaagctccagaaatgtacggggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtactag

SEQ ID NO: 13991 - DNA, 558 bp, synthetic construct
  misc_feature 1..558: note = Synthetic polypeptide
  source 1..558: mol_type = other DNA
ccatcttatcccaaaagtcttatctttctccgttgcgttcatctccacaggccatacagggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13992 - DNA, 1946 bp, synthetic construct; identical to SEQ ID NO: 10199
  misc_feature 1..1946: note = Synthetic polypeptide
  source 1..1946: mol_type = other DNA

SEQ ID NO: 13993 - DNA, 2084 bp, synthetic construct; identical to SEQ ID NO: 10200
  misc_feature 1..2084: note = Synthetic polypeptide
  source 1..2084: mol_type = other DNA

SEQ ID NO: 13994 - DNA, 1991 bp, synthetic construct
  misc_feature 1..1991: note = Synthetic polypeptide
  source 1..1991: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13995 - DNA, 1964 bp, synthetic construct
  misc_feature 1..1964: note = Synthetic polypeptide
  source 1..1964: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13996 - DNA, 1967 bp, synthetic construct
  misc_feature 1..1967: note = Synthetic polypeptide
  source 1..1967: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13997 - DNA, 1421 bp, synthetic construct
  misc_feature 1..1421: note = Synthetic polypeptide
  source 1..1421: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagaatggctgcagtggaggactggctcctgctccccagaatccttgtcatcaagagggacaactaccagcttgggacagcgggaagaccctggcctggccttggtcatttagggtcctgctggcccttttcctgggccccttgggagggaggagggctcccgggcctgagtggtgctgttcaccatactccttcctttgaggactacaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttggtga

SEQ ID NO: 13998 - DNA, 467 bp, synthetic construct
  misc_feature 1..467: note = Synthetic polypeptide
  source 1..467: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttga

SEQ ID NO: 13999 - DNA, 253 bp, synthetic construct
  misc_feature 1..253: note = Synthetic polypeptide
  source 1..253: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccag

SEQ ID NO: 14000 - DNA, 251 bp, synthetic construct
  misc_feature 1..251: note = Synthetic polypeptide
  source 1..251: mol_type = other DNA
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcagtgagtccaacccaagttgaacctggcttgcaagctgctgccagcctgggcagtgggacctgtgttccccactggggctggtga

SEQ ID NO: 14001 - DNA, 1386 bp, synthetic construct
  misc_feature 1..1386: note = Synthetic polypeptide
  source 1..1386: mol_type = other DNA
ggccgggcttggtggcttacacctgtaatcccaacactttgggaggctgagacgggtggatcacctaaggtcaggagttcatgaccagcctgaccaacatggcaaaaccctgtctctacttaaaatacaaaaattagtcgggcatggtggcttgcacctgtagtcctggctatccgggaggctgaggcaggagaattgcttgagcccgggaggaggaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14002 - DNA, 281 bp, synthetic construct
  misc_feature 1..281: note = Synthetic polypeptide
  source 1..281: mol_type = other DNA
ggccgggcttggtggcttacacctgtaatcccaacactttgggaggctgagacgggtggatcacctaaggtcaggagttcatgaccagcctgaccaacatggcaaaaccctgtctctacttaaaatacaaaaattagtcgggcatggtggcttgcacctgtagtcctggctatccgggaggctgaggcaggagaattgcttgagcccgggaggaggaggcccgacaggtcctctcaaggagggagtcttccctctgaggaaaagggacacccccaggagga

SEQ ID NO: 14003 - DNA, 1148 bp, synthetic construct
  misc_feature 1..1148: note = Synthetic polypeptide
  source 1..1148: mol_type = other DNA
gccattggcttgctctgcagccatgggtgagccactctgtctctgaacctcagctttctcatctaagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactga

SEQ ID NO: 14004 - DNA, 1443 bp, synthetic construct
  misc_feature 1..1443: note = Synthetic polypeptide
  source 1..1443: mol_type = other DNA
tctcacactaatcccttctgctctcctcctggccttgtcactgttctccaggcaccctaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtga

SEQ ID NO: 14005 - DNA, 1416 bp, synthetic construct
  misc_feature 1..1416: note = Synthetic polypeptide
  source 1..1416: mol_type = other DNA
tctcacactaatcccttctgctctcctcctggccttgtcactgttctccaggcaccctaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaa

SEQ ID NO: 14006 - DNA, 1040 bp, synthetic construct
  misc_feature 1..1040: note = Synthetic polypeptide
  source 1..1040: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacagtatgtagtgacttaattactattcatatatctctcctttag

SEQ ID NO: 14007 - DNA, 2951 bp, synthetic construct
  misc_feature 1..2951: note = Synthetic polypeptide
  source 1..2951: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataa

SEQ ID NO: 14008 - DNA, 170 bp, synthetic construct
  misc_feature 1..170: note = Synthetic polypeptide
  source 1..170: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaagttagagccctaa

SEQ ID NO: 14009 - DNA, 176 bp, synthetic construct
  misc_feature 1..176: note = Synthetic polypeptide
  source 1..176: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggtattgagctacacgtaa

SEQ ID NO: 14010 - DNA, 624 bp, synthetic construct
  misc_feature 1..624: note = Synthetic polypeptide
  source 1..624: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgc

SEQ ID NO: 14011 - DNA, 176 bp, synthetic construct
  misc_feature 1..176: note = Synthetic polypeptide
  source 1..176: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggtattgagctacacgtga

SEQ ID NO: 14012 - DNA, 2111 bp, synthetic construct
  misc_feature 1..2111: note = Synthetic polypeptide
  source 1..2111: mol_type = other DNA
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaagcatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataa

SEQ ID NO: 14013 - DNA, 983 bp, synthetic construct
  misc_feature 1..983: note = Synthetic polypeptide
  source 1..983: mol_type = other DNA
gcagaggaaggaatgacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14014 - DNA, 353 bp, synthetic construct; identical to SEQ ID NO: 10189
  misc_feature 1..353: note = Synthetic polypeptide
  source 1..353: mol_type = other DNA

SEQ ID NO: 14015 - DNA, 317 bp, synthetic construct; identical to SEQ ID NO: 10190
  misc_feature 1..317: note = Synthetic polypeptide
  source 1..317: mol_type = other DNA

SEQ ID NO: 14016 - DNA, 2084 bp, synthetic construct; identical to SEQ ID NO: 10260
  misc_feature 1..2084: note = Synthetic polypeptide
  source 1..2084: mol_type = other DNA

SEQ ID NO: 14017 - DNA, 1946 bp, synthetic construct; identical to SEQ ID NO: 10261
  misc_feature 1..1946: note = Synthetic polypeptide
  source 1..1946: mol_type = other DNA

SEQ ID NO: 14018 - DNA, 647 bp, synthetic construct; identical to SEQ ID NO: 10262
  misc_feature 1..647: note = Synthetic polypeptide
  source 1..647: mol_type = other DNA

SEQ ID NO: 14019 - DNA, 182 bp, synthetic construct; identical to SEQ ID NO: 10263
  misc_feature 1..182: note = Synthetic polypeptide
  source 1..182: mol_type = other DNA

SEQ ID NO: 14020 - DNA, 506 bp, synthetic construct
  misc_feature 1..506: note = Synthetic polypeptide
  source 1..506: mol_type = other DNA
ctgcctctaacactgatggtcctgtgactctgatgaatcattgaaccttcctgagcctgagcctccttttgtgcaaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctga

SEQ ID NO: 14021 - DNA, 484 bp, synthetic construct
  misc_feature 1..484: note = Synthetic polypeptide
  source 1..484: mol_type = other DNA
tagcagggcagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaa

SEQ ID NO: 14022 - DNA, 650 bp, synthetic construct; identical to SEQ ID NO: 9089
  misc_feature 1..650: note = Synthetic polypeptide
  source 1..650: mol_type = other DNA

SEQ ID NO: 14023 - DNA, 1052 bp, synthetic construct; identical to SEQ ID NO: 9090
  misc_feature 1..1052: note = Synthetic polypeptide
  source 1..1052: mol_type = other DNA

SEQ ID NO: 14024 - DNA, 1112 bp, synthetic construct
  misc_feature 1..1112: note = Synthetic polypeptide
  source 1..1112: mol_type = other DNA
gcagaggaaggaatgagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14025 - DNA, 790 bp, synthetic construct; identical to SEQ ID NO: 10723
  misc_feature 1..790: note = Synthetic polypeptide
  source 1..790: mol_type = other DNA

SEQ ID NO: 14026 - DNA, 466 bp, synthetic construct; identical to SEQ ID NO: 10724
  misc_feature 1..466: note = Synthetic polypeptide
  source 1..466: mol_type = other DNA

SEQ ID NO: 14027 - DNA, 763 bp, synthetic construct; identical to SEQ ID NO: 10725
  misc_feature 1..763: note = Synthetic polypeptide
  source 1..763: mol_type = other DNA

SEQ ID NO: 14028 - DNA, 585 bp, synthetic construct; identical to SEQ ID NO: 10726
  misc_feature 1..585: note = Synthetic polypeptide
  source 1..585: mol_type = other DNA

SEQ ID NO: 14029 - DNA, 311 bp, synthetic construct; identical to SEQ ID NO: 10727
  misc_feature 1..311: note = Synthetic polypeptide
  source 1..311: mol_type = other DNA

SEQ ID NO: 14030 - DNA, 1188 bp, synthetic construct; identical to SEQ ID NO: 11150
  misc_feature 1..1188: note = Synthetic polypeptide
  source 1..1188: mol_type = other DNA

SEQ ID NO: 14031 - DNA, 636 bp, synthetic construct; identical to SEQ ID NO: 11151
  misc_feature 1..636: note = Synthetic polypeptide
  source 1..636: mol_type = other DNA

SEQ ID NO: 14032 - DNA, 452 bp, synthetic construct; identical to SEQ ID NO: 11152
  misc_feature 1..452: note = Synthetic polypeptide
  source 1..452: mol_type = other DNA

SEQ ID NO: 14033 - DNA, 729 bp, synthetic construct; identical to SEQ ID NO: 11153
  misc_feature 1..729: note = Synthetic polypeptide
  source 1..729: mol_type = other DNA

SEQ ID NO: 14034 - DNA, 1224 bp, synthetic construct; identical to SEQ ID NO: 11154
  misc_feature 1..1224: note = Synthetic polypeptide
  source 1..1224: mol_type = other DNA

SEQ ID NO: 14035 - DNA, 1143 bp, synthetic construct; identical to SEQ ID NO: 11155
  misc_feature 1..1143: note = Synthetic polypeptide
  source 1..1143: mol_type = other DNA

SEQ ID NO: 14036 - DNA, 906 bp, synthetic construct; identical to SEQ ID NO: 11156
  misc_feature 1..906: note = Synthetic polypeptide
  source 1..906: mol_type = other DNA

SEQ ID NO: 14037 - DNA, 822 bp, synthetic construct; identical to SEQ ID NO: 11157
  misc_feature 1..822: note = Synthetic polypeptide
  source 1..822: mol_type = other DNA

SEQ ID NO: 14038 - DNA, 885 bp, synthetic construct; identical to SEQ ID NO: 11158
  misc_feature 1..885: note = Synthetic polypeptide
  source 1..885: mol_type = other DNA

SEQ ID NO: 14039 - DNA, 935 bp, synthetic construct; identical to SEQ ID NO: 10282
  misc_feature 1..935: note = Synthetic polypeptide
  source 1..935: mol_type = other DNA

SEQ ID NO: 14040 - DNA, 383 bp, synthetic construct; identical to SEQ ID NO: 10283
  misc_feature 1..383: note = Synthetic polypeptide
  source 1..383: mol_type = other DNA

SEQ ID NO: 14041 - DNA, 199 bp, synthetic construct; identical to SEQ ID NO: 10284
  misc_feature 1..199: note = Synthetic polypeptide
  source 1..199: mol_type = other DNA

SEQ ID NO: 14042 - DNA, 476 bp, synthetic construct; identical to SEQ ID NO: 10285
  misc_feature 1..476: note = Synthetic polypeptide
  source 1..476: mol_type = other DNA

SEQ ID NO: 14043 - DNA, 971 bp, synthetic construct; identical to SEQ ID NO: 10286
  misc_feature 1..971: note = Synthetic polypeptide
  source 1..971: mol_type = other DNA

SEQ ID NO: 14044 - DNA, 890 bp, synthetic construct; identical to SEQ ID NO: 10287
  misc_feature 1..890: note = Synthetic polypeptide
  source 1..890: mol_type = other DNA

SEQ ID NO: 14045 - DNA, 653 bp, synthetic construct; identical to SEQ ID NO: 10288
  misc_feature 1..653: note = Synthetic polypeptide
  source 1..653: mol_type = other DNA

SEQ ID NO: 14046 - DNA, 569 bp, synthetic construct; identical to SEQ ID NO: 10289
  misc_feature 1..569: note = Synthetic polypeptide
  source 1..569: mol_type = other DNA

SEQ ID NO: 14047 - DNA, 632 bp, synthetic construct; identical to SEQ ID NO: 10290
  misc_feature 1..632: note = Synthetic polypeptide
  source 1..632: mol_type = other DNA

SEQ ID NO: 14048 - DNA, 643 bp, synthetic construct
  misc_feature 1..643: note = Synthetic polypeptide
  source 1..643: mol_type = other DNA
aacttctgttttcacgttgatctgtacaaagaagataatggagattatttatctaaagtggatgttataaagattaaatgaaattaaatatggaaattacctaccagaatgcctggcacttgataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataa

SEQ ID NO: 14049 - DNA, 691 bp, synthetic construct
  misc_feature 1..691: note = Synthetic polypeptide
  source 1..691: mol_type = other DNA
aacttctgttttcacgttgatctgtacaaagaagataatggagattatttatctaaagtggatgttataaagattaaatgaaattaaatatggaaattacctaccagaatgcctggcacttgataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataa

SEQ ID NO: 14050 - DNA, 2327 bp, synthetic construct; identical to SEQ ID NO: 9672
  misc_feature 1..2327: note = Synthetic polypeptide
  source 1..2327: mol_type = other DNA

SEQ ID NO: 14051 - DNA, 1916 bp, synthetic construct; identical to SEQ ID NO: 9673
  misc_feature 1..1916: note = Synthetic polypeptide
  source 1..1916: mol_type = other DNA

SEQ ID NO: 14052 - DNA, 2384 bp, synthetic construct; identical to SEQ ID NO: 9674
  misc_feature 1..2384: note = Synthetic polypeptide
  source 1..2384: mol_type = other DNA

SEQ ID NO: 14053 - DNA, 2195 bp, synthetic construct; identical to SEQ ID NO: 9675
  misc_feature 1..2195: note = Synthetic polypeptide
  source 1..2195: mol_type = other DNA

SEQ ID NO: 14054 - DNA, 2270 bp, synthetic construct
  misc_feature 1..2270: note = Synthetic polypeptide
  source 1..2270: mol_type = other DNA
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14055 - DNA, 2177 bp, synthetic construct
  misc_feature 1..2177: note = Synthetic polypeptide
  source 1..2177: mol_type = other DNA
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14056 - DNA, 242 bp, synthetic construct
  misc_feature 1..242: note = Synthetic polypeptide
  source 1..242: mol_type = other DNA
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttataa

SEQ ID NO: 14057 - DNA, 826 bp, synthetic construct
  misc_feature 1..826: note = Synthetic polypeptide
  source 1..826: mol_type = other DNA
aacacacggacacaacctcttttccatctgactggtacaaggtgctaactttgagtacatcatcgcagaaaaaagagggaagaataacaccgtggggttgatccaactgaaccgccccaaggccctcaatgcactttgcgatggcctgattgacgagctcaaccaggccctgaagaccttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcactggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtga

SEQ ID NO: 14058 - DNA, 368 bp, synthetic construct; identical to SEQ ID NO: 6482
  misc_feature 1..368: note = Synthetic polypeptide
  source 1..368: mol_type = other DNA

SEQ ID NO: 14059 - DNA, 561 bp, synthetic construct
  misc_feature 1..561: note = Synthetic polypeptide
  source 1..561: mol_type = other DNA
gtgtgatggaatgtgccattgcctttggtgtcatacagagatgattttagatgcctgttcactcactgtctgtgtaactctgtgcaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactga

SEQ ID NO: 14060 - DNA, 942 bp, synthetic construct; identical to SEQ ID NO: 10396
  misc_feature 1..942: note = Synthetic polypeptide
  source 1..942: mol_type = other DNA

SEQ ID NO: 14061 - DNA, 390 bp, synthetic construct; identical to SEQ ID NO: 10397
  misc_feature 1..390: note = Synthetic polypeptide
  source 1..390: mol_type = other DNA

SEQ ID NO: 14062 - DNA, 206 bp, synthetic construct; identical to SEQ ID NO: 10398
  misc_feature 1..206: note = Synthetic polypeptide
  source 1..206: mol_type = other DNA

SEQ ID NO: 14063 - DNA, 483 bp, synthetic construct; identical to SEQ ID NO: 10399
  misc_feature 1..483: note = Synthetic polypeptide
  source 1..483: mol_type = other DNA

SEQ ID NO: 14064 - DNA, 978 bp, synthetic construct; identical to SEQ ID NO: 10400
  misc_feature 1..978: note = Synthetic polypeptide
  source 1..978: mol_type = other DNA

SEQ ID NO: 14065 - DNA, 897 bp, synthetic construct; identical to SEQ ID NO: 10401
  misc_feature 1..897: note = Synthetic polypeptide
  source 1..897: mol_type = other DNA

SEQ ID NO: 14066 - DNA, 660 bp, synthetic construct; identical to SEQ ID NO: 10402
  misc_feature 1..660: note = Synthetic polypeptide
  source 1..660: mol_type = other DNA

SEQ ID NO: 14067 - DNA, 576 bp, synthetic construct; identical to SEQ ID NO: 10403
  misc_feature 1..576: note = Synthetic polypeptide
  source 1..576: mol_type = other DNA

SEQ ID NO: 14068 - DNA, 639 bp, synthetic construct; identical to SEQ ID NO: 10404
  misc_feature 1..639: note = Synthetic polypeptide
  source 1..639: mol_type = other DNA

SEQ ID NO: 14069 - DNA, 742 bp, synthetic construct; identical to SEQ ID NO: 6357
  misc_feature 1..742: note = Synthetic polypeptide
  source 1..742: mol_type = other DNA

SEQ ID NO: 14070 - DNA, 590 bp, synthetic construct; identical to SEQ ID NO: 6358
  misc_feature 1..590: note = Synthetic polypeptide
  source 1..590: mol_type = other DNA

SEQ ID NO: 14071 - DNA, 577 bp, synthetic construct; identical to SEQ ID NO: 6359
  misc_feature 1..577: note = Synthetic polypeptide
  source 1..577: mol_type = other DNA

SEQ ID NO: 14072 - DNA, 430 bp, synthetic construct; identical to SEQ ID NO: 6360
  misc_feature 1..430: note = Synthetic polypeptide
  source 1..430: mol_type = other DNA

SEQ ID NO: 14073 - DNA, 670 bp, synthetic construct; identical to SEQ ID NO: 6361
  misc_feature 1..670: note = Synthetic polypeptide
  source 1..670: mol_type = other DNA

SEQ ID NO: 14074 - DNA, 330 bp, synthetic construct; identical to SEQ ID NO: 6490
  misc_feature 1..330: note = Synthetic polypeptide
  source 1..330: mol_type = other DNA

SEQ ID NO: 14075 - DNA, 1410 bp, synthetic construct
  misc_feature 1..1410: note = Synthetic polypeptide
  source 1..1410: mol_type = other DNA
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaa

SEQ ID NO: 14076 - DNA, 1548 bp, synthetic construct
  misc_feature 1..1548: note = Synthetic polypeptide
  source 1..1548: mol_type = other DNA
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaa

SEQ ID NO: 14077 - DNA, 618 bp, synthetic construct
  misc_feature 1..618: note = Synthetic polypeptide
  source 1..618: mol_type = other DNA
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcaaaggatcagacagctgctagtcttttaattaaattgtgg

SEQ ID NO: 14078 - DNA, 2157 bp, synthetic construct; identical to SEQ ID NO: 6426
  misc_feature 1..2157: note = Synthetic polypeptide
  source 1..2157: mol_type = other DNA

SEQ ID NO: 14079 - DNA, 799 bp, synthetic construct; identical to SEQ ID NO: 6427
  misc_feature 1..799: note = Synthetic polypeptide
  source 1..799: mol_type = other DNA

SEQ ID NO: 14080 - DNA, 336 bp, synthetic construct; identical to SEQ ID NO: 6428
  misc_feature 1..336: note = Synthetic polypeptide
  source 1..336: mol_type = other DNA

SEQ ID NO: 14081 - DNA, 1205 bp, synthetic construct; identical to SEQ ID NO: 11461
  misc_feature 1..1205: note = Synthetic polypeptide
  source 1..1205: mol_type = other DNA

SEQ ID NO: 14082 - DNA, 653 bp, synthetic construct; identical to SEQ ID NO: 11462
  misc_feature 1..653: note = Synthetic polypeptide
  source 1..653: mol_type = other DNA

SEQ ID NO: 14083 - DNA, 469 bp, synthetic construct; identical to SEQ ID NO: 11463
  misc_feature 1..469: note = Synthetic polypeptide
  source 1..469: mol_type = other DNA

SEQ ID NO: 14084 - DNA, 746 bp, synthetic construct; identical to SEQ ID NO: 11464
  misc_feature 1..746: note = Synthetic polypeptide
  source 1..746: mol_type = other DNA

SEQ ID NO: 14085 - DNA, 1241 bp, synthetic construct; identical to SEQ ID NO: 11465
  misc_feature 1..1241: note = Synthetic polypeptide
  source 1..1241: mol_type = other DNA

SEQ ID NO: 14086 - DNA, 1160 bp, synthetic construct; identical to SEQ ID NO: 11466
  misc_feature 1..1160: note = Synthetic polypeptide
  source 1..1160: mol_type = other DNA

SEQ ID NO: 14087 - DNA, 923 bp, synthetic construct; identical to SEQ ID NO: 11467
  misc_feature 1..923: note = Synthetic polypeptide
  source 1..923: mol_type = other DNA

SEQ ID NO: 14088 - DNA, 839 bp, synthetic construct; identical to SEQ ID NO: 11468
  misc_feature 1..839: note = Synthetic polypeptide
  source 1..839: mol_type = other DNA

SEQ ID NO: 14089 - DNA, 902 bp, synthetic construct; identical to SEQ ID NO: 11469
  misc_feature 1..902: note = Synthetic polypeptide
  source 1..902: mol_type = other DNA

SEQ ID NO: 14090 - DNA, 407 bp, synthetic construct
  misc_feature 1..407: note = Synthetic polypeptide
  source 1..407: mol_type = other DNA
gtgtattagcggtggaaaataataggaacaaggcgagacctggacttcagtcccagctctgccactaagtggcttggctgtagagcttaactcttccacagtcttcatctgtgtaatgggaataacgatccgtacctctagcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctga

SEQ ID NO: 14091 - DNA, 1070 bp, synthetic construct
  misc_feature 1..1070: note = Synthetic polypeptide
  source 1..1070: mol_type = other DNA
tgtaaaaagtaaagtaaaggttcctcttcaaagactttcctccccgtctaattagaaataaacagtaacttctcttaaaaacaaaatttattcaaagacctgtgctaacattcttaaatatctgctagctgtaataataaaaaaaaatgtactttacattcttatcttccacaatttagcctaaatatttgccctggcatgcttatactggtccaagcaagcattaagttatagcctgttcctcttccttatttaaaggtgtttttacctttctcagcattcctcaagttacttcctccttcctttgttctcctctgcctttgcctcttaaacatttctaagttgctagccaattgagacaaatacagattgtgaggtcccgttccagccaataaaaacgggacacagctgtaaagtggacgcatcaggttataaatgaccttgtctcctttgttcaatatacagtcgcggcaaaactgctgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataa

SEQ ID NO: 14092 - DNA, 1124 bp, synthetic construct
  misc_feature 1..1124: note = Synthetic polypeptide
  source 1..1124: mol_type = other DNA
tgtaaaaagtaaagtaaaggttcctcttcaaagactttcctccccgtctaattagaaataaacagtaacttctcttaaaaacaaaatttattcaaagacctgtgctaacattcttaaatatctgctagctgtaataataaaaaaaaatgtactttacattcttatcttccacaatttagcctaaatatttgccctggcatgcttatactggtccaagcaagcattaagttatagcctgttcctcttccttatttaaaggtgtttttacctttctcagcattcctcaagttacttcctccttcctttgttctcctctgcctttgcctcttaaacatttctaagttgctagccaattgagacaaatacagattgtgaggtcccgttccagccaataaaaacgggacacagctgtaaagtggacgcatcaggttataaatgaccttgtctcctttgttcaatatacagtcgcggcaaaactgctgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagaaactactccaaaccagggggccactggctaacttgaataatccagaaggcttggaatatctatccatcaaatttgggcattaa

SEQ ID NO: 14093 - DNA, 647 bp, synthetic construct
  misc_feature 1..647: note = Synthetic polypeptide
  source 1..647: mol_type = other DNA
ccctgtgcctcagtttcctcatctgtaagatacaggggctggagagaatggtggggttctaagactaattcccagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctga

SEQ ID NO: 14094 - DNA, 599 bp, synthetic construct
  misc_feature 1..599: note = Synthetic polypeptide
  source 1..599: mol_type = other DNA
ccctgtgcctcagtttcctcatctgtaagatacaggggctggagagaatggtggggttctaagactaattcccagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctga

SEQ ID NO: 14095 - DNA, 1137 bp, synthetic construct; identical to SEQ ID NO: 11406
  misc_feature 1..1137: note = Synthetic polypeptide
  source 1..1137: mol_type = other DNA

SEQ ID NO: 14096 - DNA, 585 bp, synthetic construct; identical to SEQ ID NO: 11407
  misc_feature 1..585: note = Synthetic polypeptide
  source 1..585: mol_type = other DNA

SEQ ID NO: 14097 - DNA, 401 bp, synthetic construct; identical to SEQ ID NO: 11408
  misc_feature 1..401: note = Synthetic polypeptide
  source 1..401: mol_type = other DNA

SEQ ID NO: 14098 - DNA, 678 bp, synthetic construct; identical to SEQ ID NO: 11409
  misc_feature 1..678: note = Synthetic polypeptide
  source 1..678: mol_type = other DNA

SEQ ID NO: 14099 - DNA, 1173 bp, synthetic construct; identical to SEQ ID NO: 11410
  misc_feature 1..1173: note = Synthetic polypeptide
  source 1..1173: mol_type = other DNA

SEQ ID NO: 14100 - DNA, 1092 bp, synthetic construct; identical to SEQ ID NO: 11411
  misc_feature 1..1092: note = Synthetic polypeptide
  source 1..1092: mol_type = other DNA

SEQ ID NO: 14101 - DNA, 855 bp, synthetic construct; identical to SEQ ID NO: 11412
  misc_feature 1..855: note = Synthetic polypeptide
  source 1..855: mol_type = other DNA

SEQ ID NO: 14102 - DNA, 771 bp, synthetic construct; identical to SEQ ID NO: 11413
  misc_feature 1..771: note = Synthetic polypeptide
  source 1..771: mol_type = other DNA

SEQ ID NO: 14103 - DNA, 834 bp, synthetic construct; identical to SEQ ID NO: 11414
  misc_feature 1..834: note = Synthetic polypeptide
  source 1..834: mol_type = other DNA

SEQ ID NO: 14104 - DNA, 460 bp, synthetic construct
  misc_feature 1..460: note = Synthetic polypeptide
  source 1..460: mol_type = other DNA
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctag

SEQ ID NO: 14105 - DNA, 424 bp, synthetic construct
  misc_feature 1..424: note = Synthetic polypeptide
  source 1..424: mol_type = other DNA
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatg

SEQ ID NO: 14106 - DNA, 313 bp, synthetic construct
  misc_feature 1..313: note = Synthetic polypeptide
  source 1..313: mol_type = other DNA
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 14107 - DNA, 227 bp, synthetic construct
  misc_feature 1..227: note = Synthetic polypeptide
  source 1..227: mol_type = other DNA
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatcctta

SEQ ID NO: 14108 - DNA, 725 bp, synthetic construct
  misc_feature 1..725: note = Synthetic polypeptide
  source 1..725: mol_type = other DNA
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttga

SEQ ID NO: 14109 - DNA, 695 bp, synthetic construct
  misc_feature 1..695: note = Synthetic polypeptide
  source 1..695: mol_type = other DNA
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtaa

SEQ ID NO: 14110 - DNA, 401 bp, synthetic construct
  misc_feature 1..401: note = Synthetic polypeptide
  source 1..401: mol_type = other DNA
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatag

SEQ ID NO: 14111 - DNA, 899 bp, synthetic construct
  misc_feature 1..899: note = Synthetic polypeptide
  source 1..899: mol_type = other DNA
aggaatgaactattgatgcgtgcagcagcctggatgcatctcaaggaaatgatgctgagtgagaaagcagcatatgcagaagggaacatactgtacgattctgcttccatgacattctggaaataacagaattatgacagtggagaacagatgagtagttgccaaagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14112 - DNA, 361 bp, synthetic construct
  misc_feature 1..361: note = Synthetic polypeptide
  source 1..361: mol_type = other DNA
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaa

SEQ ID NO: 14113 - DNA, 1046 bp, synthetic construct
  misc_feature 1..1046: note = Synthetic polypeptide
  source 1..1046: mol_type = other DNA
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattga

SEQ ID NO: 14114 - DNA, 485 bp, synthetic construct
  misc_feature 1..485: note = Synthetic polypeptide
  source 1..485: mol_type = other DNA
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagatggagtctcactctgtcgccgaggctga

SEQ ID NO: 14115 - DNA, 467 bp, synthetic construct
  misc_feature 1..467: note = Synthetic polypeptide
  source 1..467: mol_type = other DNA
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagctattggatga

SEQ ID NO: 14116 - DNA, 473 bp, synthetic construct
  misc_feature 1..473: note = Synthetic polypeptide
  source 1..473: mol_type = other DNA
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagaagtacttcagatttga

SEQ ID NO: 14117 - DNA, 1453 bp, synthetic construct
  misc_feature 1..1453: note = Synthetic polypeptide
  source 1..1453: mol_type = other DNA
gatggtgtcagaaataggacctatagtagaacttccagcgacccccggaagcatagagtgaccaaatggtgtacccgctgggcccattgtgtccattgctctctcgcagccactggggatcgtgggtaagttctctttcagactttgaagctccacggctttgtgttctgagctatctgagtttgtttgagcagatttttttttttttttatctgaactgggtttggaagttgttacagaaactggactgggtccaggatcaaattaggtctgataattaactgacttagatctagttaaaggcctcagatgtctgaatcagacagaaactgacagtaaatggcaatattgtaggtagtatgaacttcagctttcagaaatttgcagggacttttgtgttctatcccctttgtttctttttcttgcactcataggtaggaaaaaagtcaatgactaagttgtgaggaaatctgagagccaaagccaagattcaacataaaaatgagatccttaatttctgaagaactgagtactccactttctggctacaactacctacaaacacttacaaaaatggcaaaatgttactaaagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcagtataaaaaagcaatattgacactggtaaagcagaaatacttggattcatttactccatgctggttaaatctaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaa

SEQ ID NO: 14118 - DNA, 68 bp, synthetic construct; identical to SEQ ID NO: 6862
  misc_feature 1..68: note = Synthetic polypeptide
  source 1..68: mol_type = other DNA

SEQ ID NO: 14119 - DNA, 1053 bp, synthetic construct; identical to SEQ ID NO: 6863
  misc_feature 1..1053: note = Synthetic polypeptide
  source 1..1053: mol_type = other DNA

SEQ ID NO: 14120 - DNA, 407 bp, synthetic construct; identical to SEQ ID NO: 6864
  misc_feature 1..407: note = Synthetic polypeptide
  source 1..407: mol_type = other DNA

SEQ ID NO: 14121 - DNA, 673 bp, synthetic construct; identical to SEQ ID NO: 6865
  misc_feature 1..673: note = Synthetic polypeptide
  source 1..673: mol_type = other DNA

SEQ ID NO: 14122 - DNA, 1204 bp, synthetic construct; identical to SEQ ID NO: 11522
  misc_feature 1..1204: note = Synthetic polypeptide
  source 1..1204: mol_type = other DNA

SEQ ID NO: 14123 - DNA, 652 bp, synthetic construct; identical to SEQ ID NO: 11523
  misc_feature 1..652: note = Synthetic polypeptide
  source 1..652: mol_type = other DNA

SEQ ID NO: 14124 - DNA, 468 bp, synthetic construct; identical to SEQ ID NO: 11524
  misc_feature 1..468: note = Synthetic polypeptide
  source 1..468: mol_type = other DNA

SEQ ID NO: 14125 - DNA, 745 bp, synthetic construct; identical to SEQ ID NO: 11525
  misc_feature 1..745: note = Synthetic polypeptide
  source 1..745: mol_type = other DNA

SEQ ID NO: 14126 - DNA, 1240 bp, synthetic construct; identical to SEQ ID NO: 11526
  misc_feature 1..1240: note = Synthetic polypeptide
  source 1..1240: mol_type = other DNA

SEQ ID NO: 14127 - DNA, 1159 bp, synthetic construct; identical to SEQ ID NO: 11527
  misc_feature 1..1159: note = Synthetic polypeptide
  source 1..1159: mol_type = other DNA

SEQ ID NO: 14128 - DNA, 922 bp, synthetic construct; identical to SEQ ID NO: 11528
  misc_feature 1..922: note = Synthetic polypeptide
  source 1..922: mol_type = other DNA

SEQ ID NO: 14129 - DNA, 838 bp, synthetic construct; identical to SEQ ID NO: 11529
  misc_feature 1..838: note = Synthetic polypeptide
  source 1..838: mol_type = other DNA

SEQ ID NO: 14130 - DNA, 901 bp, synthetic construct; identical to SEQ ID NO: 11530
  misc_feature 1..901: note = Synthetic polypeptide
  source 1..901: mol_type = other DNA

SEQ ID NO: 14131 - DNA, 1435 bp, synthetic construct
  misc_feature 1..1435: note = Synthetic polypeptide
  source 1..1435: mol_type = other DNA
tgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactga

SEQ ID NO: 14132 - DNA, 340 bp, synthetic construct
  misc_feature 1..340: note = Synthetic polypeptide
  source 1..340: mol_type = other DNA
tgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactga

SEQ ID NO: 14133 - DNA, 425 bp, synthetic construct; identical to SEQ ID NO: 6825
  misc_feature 1..425: note = Synthetic polypeptide
  source 1..425: mol_type = other DNA

SEQ ID NO: 14134 - DNA, 1013 bp, synthetic construct; identical to SEQ ID NO: 6826
  misc_feature 1..1013: note = Synthetic polypeptide
  source 1..1013: mol_type = other DNA

SEQ ID NO: 14135 - DNA, 413 bp, synthetic construct; identical to SEQ ID NO: 6827
  misc_feature 1..413: note = Synthetic polypeptide
  source 1..413: mol_type = other DNA

SEQ ID NO: 14136 - DNA, 854 bp, synthetic construct; identical to SEQ ID NO: 6828
  misc_feature 1..854: note = Synthetic polypeptide
  source 1..854: mol_type = other DNA

SEQ ID NO: 14137 - DNA, 1393 bp, synthetic construct
  misc_feature 1..1393: note = Synthetic polypeptide
  source 1..1393: mol_type = other DNA
aaagccctatttttataggtagtggatgaagaagagtccttcccctatcccctatgtgagtcaggcattgtcagagagattatggaaggttgaagaaagtaaacctataaagttttatatgaacactccttagccattttgcatggatctgaccctaaacagcacatcagaggctttgaaaactagaatacacaatagactgcctctccagggccagcctggccattgggtggcaaataagtggggcagatgcaaataacatagcaaaggagttcataacaaacctgacactggaaccataacacaacctagaaacattgagtaaaaacttgaagcctaaaccaaaccagattgtctgctgaaagtttttaaaaatcaagacctagaatgatgtaacatgtcaaaatatccaggatgccatcctaaattagtcaacatactcaaaaccaggaaaatcttaacatctcaaaggaaaagacagcagacaccaacctcaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttga

SEQ ID NO: 14138 - DNA, 1581 bp, synthetic construct
  misc_feature 1..1581: note = Synthetic polypeptide
  source 1..1581: mol_type = other DNA
atggttaattttatgtgtcaagctgacttggtcatgggatgcccaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14139 - DNA, 391 bp, synthetic construct
  misc_feature 1..391: note = Synthetic polypeptide
  source 1..391: mol_type = other DNA
cagtggtccccaacccctgggccacagaccagtactagtctgtgtggcctgttaggaacctggccacacagcaggaggtgagcggtggacaagaaaacaaagcttgctccccatcactcacgttaccgcctgacctctgcctcctgtcagatcgtcggcggcattagattctcataggagcacgaaccctgtgaacattgtgaaatgtgcatgctagggatctagcttgcatctaccttatgagaatctagtgcctgatcatctgtcattgtctcccatcacccccagatgggaccatctagttgcaggaaaacaagctcagggatcccactgattctacattatgagatgggatctcgctgtgttgtcctggctggtctcaaactcctag

SEQ ID NO: 14140 - DNA, 1389 bp, synthetic construct
  misc_feature 1..1389: note = Synthetic polypeptide
  source 1..1389: mol_type = other DNA
tgtgagggttaatattaggggtcaacctgattggattgaaggatgcctaggcagctggaaaagtcttgtttctgggtatgtctctgagggtattgccagaggagactgccatttgagtcagtggactgagagaggaagactcaccctcaacatgggtgggcactatccaatcggctgctagcacggctagaacaaagcaggtggaagaaggtgttataaccttgcttgcctgccgagtcttctgatttccttctttttcctaagccagatgcttccttccactctttctgcccttggacatcagaatccagattctttggcctttggactctaggacttgcatcagtggcttcctgggggctctcagaccttcagccacagactgaagcctgcacttgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatga

SEQ ID NO: 14141 - DNA, 452 bp, synthetic construct
  misc_feature 1..452: note = Synthetic polypeptide
  source 1..452: mol_type = other DNA
caggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatgggctgccggggagcgctatcgcagggagatgctggcccacggtggaggcagggagcccatgctcatggttgaaggtatgcttcagaagtgtccttctgttgatgacttcgtaa

SEQ ID NO: 14142 - DNA, 511 bp, synthetic construct
  misc_feature 1..511: note = Synthetic polypeptide
  source 1..511: mol_type = other DNA
caggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatgggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataa

SEQ ID NO: 14143 - DNA, 820 bp, synthetic construct; identical to SEQ ID NO: 9718
  misc_feature 1..820: note = Synthetic polypeptide
  source 1..820: mol_type = other DNA

SEQ ID NO: 14144 - DNA, 307 bp, synthetic construct; identical to SEQ ID NO: 9719
  misc_feature 1..307: note = Synthetic polypeptide
  source 1..307: mol_type = other DNA

SEQ ID NO: 14145 - DNA, 622 bp, synthetic construct; identical to SEQ ID NO: 9720
  misc_feature 1..622: note = Synthetic polypeptide
  source 1..622: mol_type = other DNA

SEQ ID NO: 14146 - DNA, 718 bp, synthetic construct; identical to SEQ ID NO: 9721
  misc_feature 1..718: note = Synthetic polypeptide
  source 1..718: mol_type = other DNA

SEQ ID NO: 14147 - DNA, 409 bp, synthetic construct; identical to SEQ ID NO: 9722
  misc_feature 1..409: note = Synthetic polypeptide
  source 1..409: mol_type = other DNA

SEQ ID NO: 14148 - DNA, 691 bp, synthetic construct; identical to SEQ ID NO: 9723
  misc_feature 1..691: note = Synthetic polypeptide
  source 1..691: mol_type = other DNA

SEQ ID NO: 14149 - DNA, 751 bp, synthetic construct; identical to SEQ ID NO: 9724
  misc_feature 1..751: note = Synthetic polypeptide
  source 1..751: mol_type = other DNA

SEQ ID NO: 14150 - DNA, 838 bp, synthetic construct; identical to SEQ ID NO: 9725
  misc_feature 1..838: note = Synthetic polypeptide
  source 1..838: mol_type = other DNA

SEQ ID NO: 14151 - DNA, 536 bp, synthetic construct; identical to SEQ ID NO: 7623
  misc_feature 1..536: note = Synthetic polypeptide
  source 1..536: mol_type = other DNA

SEQ ID NO: 14152 - DNA, 369 bp, synthetic construct; identical to SEQ ID NO: 7297
  misc_feature 1..369: note = Synthetic polypeptide
  source 1..369: mol_type = other DNA

SEQ ID NO: 14153 - DNA, 2239 bp, synthetic construct
  misc_feature 1..2239: note = Synthetic polypeptide
  source 1..2239: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14154 - DNA, 2227 bp, synthetic construct
  misc_feature 1..2227: note = Synthetic polypeptide
  source 1..2227: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14155 - DNA, 1418 bp, synthetic construct
  misc_feature 1..1418: note = Synthetic polypeptide
  source 1..1418: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcattcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14156 - DNA, 2462 bp, synthetic construct
  misc_feature 1..2462: note = Synthetic polypeptide
  source 1..2462: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14157 - DNA, 2450 bp, synthetic construct
  misc_feature 1..2450: note = Synthetic polypeptide
  source 1..2450: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14158 - DNA, 1641 bp, synthetic construct
  misc_feature 1..1641: note = Synthetic polypeptide
  source 1..1641: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcattcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14159 - DNA, 1221 bp, synthetic construct
  misc_feature 1..1221: note = Synthetic polypeptide
  source 1..1221: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaa

SEQ ID NO: 14160 - DNA, 751 bp, synthetic construct
  misc_feature 1..751: note = Synthetic polypeptide
  source 1..751: mol_type = other DNA
gatgacaagtaggtaatatttagcatgctaactctgactttctgtttaactccagtgctgtttggcgctctgtgctgataagaatcctaaagcctcgtgtggtcttagcgggaaagagcactaggctagacgagaagtgtgtgccacggtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttag

SEQ ID NO: 14161 - DNA, 835 bp, synthetic construct
  misc_feature 1..835: note = Synthetic polypeptide
  source 1..835: mol_type = other DNA
gatgacaagtaggtaatatttagcatgctaactctgactttctgtttaactccagtgctgtttggcgctctgtgctgataagaatcctaaagcctcgtgtggtcttagcgggaaagagcactaggctagacgagaagtgtgtgccacggtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaa

SEQ ID NO: 14162 - DNA, 131 bp, synthetic construct
  misc_feature 1..131: note = Synthetic polypeptide
  source 1..131: mol_type = other DNA
ctgctctgtttgtgtccgcagcacgtggagacgttctcttccagatggctgaagtccacaggcagatccagaatcagctggaagaaatgccctgccctgcctcctgttccgggtccatgtgttggagctga

SEQ ID NO: 14163 - DNA, 223 bp, synthetic construct
  misc_feature 1..223: note = Synthetic polypeptide
  source 1..223: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtca

SEQ ID NO: 14164 - DNA, 1376 bp, synthetic construct
  misc_feature 1..1376: note = Synthetic polypeptide
  source 1..1376: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtga

SEQ ID NO: 14165 - DNA, 161 bp, synthetic construct
  misc_feature 1..161: note = Synthetic polypeptide
  source 1..161: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggctgcgctga

SEQ ID NO: 14166 - DNA, 1415 bp, synthetic construct
  misc_feature 1..1415: note = Synthetic polypeptide
  source 1..1415: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctga

SEQ ID NO: 14167 - DNA, 1349 bp, synthetic construct
  misc_feature 1..1349: note = Synthetic polypeptide
  source 1..1349: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaa

SEQ ID NO: 14168 - DNA, 1373 bp, synthetic construct
  misc_feature 1..1373: note = Synthetic polypeptide
  source 1..1373: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctga

SEQ ID NO: 14169 - DNA, 1469 bp, synthetic construct
  misc_feature 1..1469: note = Synthetic polypeptide
  source 1..1469: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatga

SEQ ID NO: 14170 - DNA, 291 bp, synthetic construct
  misc_feature 1..291: note = Synthetic polypeptide
  source 1..291: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaagg

SEQ ID NO: 14171 - DNA, 397 bp, synthetic construct
  misc_feature 1..397: note = Synthetic polypeptide
  source 1..397: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgctt

SEQ ID NO: 14172 - DNA, 391 bp, synthetic construct
  misc_feature 1..391: note = Synthetic polypeptide
  source 1..391: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgctt

SEQ ID NO: 14173 - DNA, 327 bp, synthetic construct
  misc_feature 1..327: note = Synthetic polypeptide
  source 1..327: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagg

SEQ ID NO: 14174 - DNA, 688 bp, synthetic construct
  misc_feature 1..688: note = Synthetic polypeptide
  source 1..688: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgccca

SEQ ID NO: 14175 - DNA, 525 bp, synthetic construct
  misc_feature 1..525: note = Synthetic polypeptide
  source 1..525: mol_type = other DNA
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagc

SEQ ID NO: 14176 - DNA, 853 bp, synthetic construct; identical to SEQ ID NO: 8074
  misc_feature 1..853: note = Synthetic polypeptide
  source 1..853: mol_type = other DNA

SEQ ID NO: 14177 - DNA, 1789 bp, synthetic construct
  misc_feature 1..1789: note = Synthetic polypeptide
  source 1..1789: mol_type = other DNA
cagtggtccccaacccctgggccacagaccagtactagtctgtgtggcctgttaggaacctggccacacagcaggaggtgagcggtggacaagaaaacaaagcttgctccccatcactcacgttaccgcctgacctctgcctcctgtcagatcgtcggcggcattagattctcataggagcacgaaccctgtgaacattgtgaaatgtgcatgctagggatctagcttgcatctaccttatgagaatctagtgcctgatcatctgtcattgtctcccatcacccccagatgggaccatctagttgcaggaaaacaagctcagggatcccactgattctacattatgacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14178 - DNA, 221 bp, synthetic construct
  misc_feature 1..221: note = Synthetic polypeptide
  source 1..221: mol_type = other DNA
ggctgggcagggtggctcatgcctgtaatcccagcactttgggaggcgaggcaggcagatcacttgagggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 14179 - DNA, 73 bp, synthetic construct
  misc_feature 1..73: note = Synthetic polypeptide
  source 1..73: mol_type = other DNA
ggctgggcagggtggctcatgcctgtaatcccagcactttgggaggcgaggcaggcagatcacttgagggtga

SEQ ID NO: 14180 - DNA, 5350 bp, synthetic construct; identical to SEQ ID NO: 655
  misc_feature 1..5350: note = Synthetic polypeptide
  source 1..5350: mol_type = other DNA

SEQ ID NO: 14181 - DNA, 1775 bp, synthetic construct; identical to SEQ ID NO: 568
  misc_feature 1..1775: note = Synthetic polypeptide
  source 1..1775: mol_type = other DNA

SEQ ID NO: 14182 - DNA, 469 bp, synthetic construct
  misc_feature 1..469: note = Synthetic polypeptide
  source 1..469: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14183 - DNA, 680 bp, synthetic construct
  misc_feature 1..680: note = Synthetic polypeptide
  source 1..680: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14184 - DNA, 167 bp, synthetic construct
  misc_feature 1..167: note = Synthetic polypeptide
  source 1..167: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggccaggtga

SEQ ID NO: 14185 - DNA, 522 bp, synthetic construct
  misc_feature 1..522: note = Synthetic polypeptide
  source 1..522: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14186 - DNA, 578 bp, synthetic construct
  misc_feature 1..578: note = Synthetic polypeptide
  source 1..578: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14187 - DNA, 269 bp, synthetic construct
  misc_feature 1..269: note = Synthetic polypeptide
  source 1..269: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14188 - DNA, 611 bp, synthetic construct
  misc_feature 1..611: note = Synthetic polypeptide
  source 1..611: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14189 - DNA, 698 bp, synthetic construct
  misc_feature 1..698: note = Synthetic polypeptide
  source 1..698: mol_type = other DNA
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14190 - DNA, 1429 bp, synthetic construct
  misc_feature 1..1429: note = Synthetic polypeptide
  source 1..1429: mol_type = other DNA
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctga

SEQ ID NO: 14191 - DNA, 1537 bp, synthetic construct
  misc_feature 1..1537: note = Synthetic polypeptide
  source 1..1537: mol_type = other DNA
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctga

SEQ ID NO: 14192 - DNA, 721 bp, synthetic construct
  misc_feature 1..721: note = Synthetic polypeptide
  source 1..721: mol_type = other DNA
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagag

SEQ ID NO: 14193 - DNA, 698 bp, synthetic construct
  misc_feature 1..698: note = Synthetic polypeptide
  source 1..698: mol_type = other DNA
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactc

SEQ ID NO: 14194 - DNA, 1540 bp, synthetic construct
  misc_feature 1..1540: note = Synthetic polypeptide
  source 1..1540: mol_type = other DNA
gccaggtgtggtggctcacacctgtaatcccagcactttgggaggccaaggcaggaggatctcttgagcccaggagtttgcgaccagcctgggcaacaaagggagactccatctctacaaaaaatacaaaaattagctgggtgtgatgtacttgcctgtggtcccagctacttgggaggctgaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataa

SEQ ID NO: 14195 - DNA, 2032 bp, synthetic construct
  misc_feature 1..2032: note = Synthetic polypeptide
  source 1..2032: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14196 - DNA, 2020 bp, synthetic construct
  misc_feature 1..2020: note = Synthetic polypeptide
  source 1..2020: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14197 - DNA, 1331 bp, synthetic construct
  misc_feature 1..1331: note = Synthetic polypeptide
  source 1..1331: mol_type = other DNA
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14198 - DNA, 799 bp, synthetic construct
  misc_feature 1..799: note = Synthetic polypeptide
  source 1..799: mol_type = other DNA
tttcagaagtcaaaagaggcccgagtcactcctaatttttaaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtga

SEQ ID NO: 14199 - DNA, 3532 bp, synthetic construct
  misc_feature 1..3532: note = Synthetic polypeptide
  source 1..3532: mol_type = other DNA
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14200 - DNA, 3673 bp, synthetic construct
  misc_feature 1..3673: note = Synthetic polypeptide
  source 1..3673: mol_type = other DNA
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14201 - DNA, 2275 bp, synthetic construct
  misc_feature 1..2275: note = Synthetic polypeptide
  source 1..2275: mol_type = other DNA
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctag

SEQ ID NO: 14202 - DNA, 1704 bp, synthetic construct
  misc_feature 1..1704: note = Synthetic polypeptide
  source 1..1704: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14203 - DNA, 1104 bp, synthetic construct
  misc_feature 1..1104: note = Synthetic polypeptide
  source 1..1104: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 14204 - DNA, 387 bp, synthetic construct
  misc_feature 1..387: note = Synthetic polypeptide
  source 1..387: mol_type = other DNA
ggccaggcacagtggctcacgcctgtaatcccagcactttatgaatcccagcattcattagacgaggctgaggcaggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataa

SEQ ID NO: 14205 - DNA, 107 bp, synthetic construct
  misc_feature 1..107: note = Synthetic polypeptide
  source 1..107: mol_type = other DNA
ggccaggcacggtggctcacgcctgtaatccaagcactttgggaggccaaggcggcggatcacgaggagatcgagaccatcctggctaacacggagactgtgcctga

SEQ ID NO: 14206 - DNA, 294 bp, synthetic construct; identical to SEQ ID NO: 6802
  misc_feature 1..294: note = Synthetic polypeptide
  source 1..294: mol_type = other DNA

SEQ ID NO: 14207 - DNA, 996 bp, synthetic construct
  misc_feature 1..996: note = Synthetic polypeptide
  source 1..996: mol_type = other DNA
gtgattaagtgcatagcctctggaataacaagatttgaattcaaacagcatttaatagctgtgtgagctgtttcctcatctgtaaaatggagacaataatgatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttga

SEQ ID NO: 14208 - DNA, 2406 bp, synthetic construct
  misc_feature 1..2406: note = Synthetic polypeptide
  source 1..2406: mol_type = other DNA
ttaagcaaccactaccctgatcagtcggcagccagcaacataaaagcagtattccctctaacagcaaaaagattgcgacttactgaaggctcggatgatcgttgtcattttttagcaatatttttaaattaaggagagtcaagccctacccgtcgagaagctgtgaagagaagaacagccgagtacctcatgcgggcagaaagtatctctagtctttatgggaaacctcagcttgatgatgtatctcaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatga

SEQ ID NO: 14209 - DNA, 2499 bp, synthetic construct
  misc_feature 1..2499: note = Synthetic polypeptide
  source 1..2499: mol_type = other DNA
ttaagcaaccactaccctgatcagtcggcagccagcaacataaaagcagtattccctctaacagcaaaaagattgcgacttactgaaggctcggatgatcgttgtcattttttagcaatatttttaaattaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatga

SEQ ID NO: 14210 - DNA, 847 bp, synthetic construct
  misc_feature 1..847: note = Synthetic polypeptide
  source 1..847: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14211 - DNA, 456 bp, synthetic construct
  misc_feature 1..456: note = Synthetic polypeptide
  source 1..456: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctga

SEQ ID NO: 14212 - DNA, 883 bp, synthetic construct
  misc_feature 1..883: note = Synthetic polypeptide
  source 1..883: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14213 - DNA, 823 bp, synthetic construct
  misc_feature 1..823: note = Synthetic polypeptide
  source 1..823: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14214 - DNA, 432 bp, synthetic construct
  misc_feature 1..432: note = Synthetic polypeptide
  source 1..432: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctga

SEQ ID NO: 14215 - DNA, 859 bp, synthetic construct
  misc_feature 1..859: note = Synthetic polypeptide
  source 1..859: mol_type = other DNA
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14216 - DNA, 1002 bp, synthetic construct
  misc_feature 1..1002: note = Synthetic polypeptide
  source 1..1002: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataa

SEQ ID NO: 14217 - DNA, 1590 bp, synthetic construct
  misc_feature 1..1590: note = Synthetic polypeptide
  source 1..1590: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14218 - DNA, 990 bp, synthetic construct
  misc_feature 1..990: note = Synthetic polypeptide
  source 1..990: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 14219 - DNA, 1431 bp, synthetic construct
  misc_feature 1..1431: note = Synthetic polypeptide
  source 1..1431: mol_type = other DNA
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 14220 - DNA, 376 bp, synthetic construct; identical to SEQ ID NO: 10759
  misc_feature 1..376: note = Synthetic polypeptide
  source 1..376: mol_type = other DNA

SEQ ID NO: 14221 - DNA, 83 bp, synthetic construct; identical to SEQ ID NO: 10925
  misc_feature 1..83: note = Synthetic polypeptide
  source 1..83: mol_type = other DNA

SEQ ID NO: 14222 - DNA, 555 bp, synthetic construct; identical to SEQ ID NO: 10926
  misc_feature 1..555: note = Synthetic polypeptide
  source 1..555: mol_type = other DNA

SEQ ID NO: 14223 - DNA, 74 bp, synthetic construct; identical to SEQ ID NO: 7010
  misc_feature 1..74: note = Synthetic polypeptide
  source 1..74: mol_type = other DNA

SEQ ID NO: 14224 - DNA, 305 bp, synthetic construct; identical to SEQ ID NO: 6836
  misc_feature 1..305: note = Synthetic polypeptide
  source 1..305: mol_type = other DNA

SEQ ID NO: 14225 - DNA, 423 bp, synthetic construct
  misc_feature 1..423: note = Synthetic polypeptide
  source 1..423: mol_type = other DNA
gaagaaatctacaatgggagtcaagaaatacttgaaatggctgataatgaaaatgccacacattaagatttgtgcagtgcagctaaagtctggctctgagaaagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14226 - DNA, 273 bp, synthetic construct
  misc_feature 1..273: note = Synthetic polypeptide
  source 1..273: mol_type = other DNA
gaagaaatctacaatgggagtcaagaaatacttgaaatggctgataatgaaaatgccacacattaagatttgtgcagtgcagctaaagtctggctctgagaaagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 14227 - DNA, 325 bp, synthetic construct
  misc_feature 1..325: note = Synthetic polypeptide
  source 1..325: mol_type = other DNA
ggccgggcacgatggctcaagcctgtaatcccagccctttgggaggctgaggcacgctgatcacctgaggtcaggagttcaagatcagcctggccaacatggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataa

SEQ ID NO: 14228 - DNA, 226 bp, synthetic construct
  misc_feature 1..226: note = Synthetic polypeptide
  source 1..226: mol_type = other DNA
ggccgggcacgatggctcaagcctgtaatcccagccctttgggaggctgaggcacgctgatcacctgaggtcaggagttcaagatcagcctggccaacatggtgtttgtaaaatgtatgaagaacatctgaaaagaatgaatcccaacagtccctctatcacatatgacatcagtcagttgtttgatttcatcgatgatctggcagacctcagctgcctggtgtaa

SEQ ID NO: 14229 - DNA, 884 bp, synthetic construct
  misc_feature 1..884: note = Synthetic polypeptide
  source 1..884: mol_type = other DNA
gaagagctttataaccagagcgttccaacaacgtatcagcgtgtcctggtacagctggaagctacttcttcctggaagagtttcactgaggattagaattacgtgtcaggatgggttgtctctataaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 14230 - DNA, 168 bp, synthetic construct
  misc_feature 1..168: note = Synthetic polypeptide
  source 1..168: mol_type = other DNA
gaagagctttataaccagagcgttccaacaacgtatcagcgtgtcctggtacagctggaagctacttcttcctggaagagtttcactgaggattagaattacgtgtcaggatgggttgtctctataaggtgatctgcaactctttcaccatctgtaatgcggagatgc

SEQ ID NO: 14231 - DNA, 250 bp, synthetic construct; identical to SEQ ID NO: 6839
  misc_feature 1..250: note = Synthetic polypeptide
  source 1..250: mol_type = other DNA

SEQ ID NO: 14232 - DNA, 1940 bp, synthetic construct
  misc_feature 1..1940: note = Synthetic polypeptide
  source 1..1940: mol_type = other DNA
atggttaattttatgtgtcaagctgacttggtcatgggatgcccaggtaactggttaaacattatttctgggtgtctgcgtgtgagggtgtttttggaagagattaatgtttgaaaagactgtgtaatgctgattgccttcaatttgggcaatcggttgagagcctgaatagaacagaaaaggggaggaaggttgaatttgctctctgcctgactgtgtgagctggactttgatcctctcctgccctcagcactcctggttctcaggccttcagacctggactggaatctgttccatctgctctctagttctctggctctcaggactttgaaagctacaacaccagctttcctgggtctccagtctgtagatggcagattgtagagcttctcaccctccataattgtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14233 - DNA, 1130 bp, synthetic construct
  misc_feature 1..1130: note = Synthetic polypeptide
  source 1..1130: mol_type = other DNA
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14234 - DNA, 1031 bp, synthetic construct
  misc_feature 1..1031: note = Synthetic polypeptide
  source 1..1031: mol_type = other DNA
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14235 - DNA, 1226 bp, synthetic construct
  misc_feature 1..1226: note = Synthetic polypeptide
  source 1..1226: mol_type = other DNA
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 14236 - DNA, 811 bp, synthetic construct; identical to SEQ ID NO: 7106
  misc_feature 1..811: note = Synthetic polypeptide
  source 1..811: mol_type = other DNA

SEQ ID NO: 14237 - DNA, 1040 bp, synthetic construct
  misc_feature 1..1040: note = Synthetic polypeptide
  source 1..1040: mol_type = other DNA
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14238 - DNA, 1001 bp, synthetic construct
  misc_feature 1..1001: note = Synthetic polypeptide
  source 1..1001: mol_type = other DNA
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14239 - DNA, 830 bp, synthetic construct
  misc_feature 1..830: note = Synthetic polypeptide
  source 1..830: mol_type = other DNA
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14240 - DNA, 618 bp, synthetic construct
  misc_feature 1..618: note = Synthetic polypeptide
  source 1..618: mol_type = other DNA
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccaga

SEQ ID NO: 14241 - DNA, 643 bp, synthetic construct
  misc_feature 1..643: note = Synthetic polypeptide
  source 1..643: mol_type = other DNA
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagagaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaact

SEQ ID NO: 14242 - DNA, 634 bp, synthetic construct
  misc_feature 1..634: note = Synthetic polypeptide
  source 1..634: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttga

SEQ ID NO: 14243 - DNA, 178 bp, synthetic construct
  misc_feature 1..178: note = Synthetic polypeptide
  source 1..178: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaagtaaaagaggtgaggacgtatttctag

SEQ ID NO: 14244 - DNA, 589 bp, synthetic construct
  misc_feature 1..589: note = Synthetic polypeptide
  source 1..589: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttga

SEQ ID NO: 14245 - DNA, 160 bp, synthetic construct
  misc_feature 1..160: note = Synthetic polypeptide
  source 1..160: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggcacttga

SEQ ID NO: 14246 - DNA, 286 bp, synthetic construct
  misc_feature 1..286: note = Synthetic polypeptide
  source 1..286: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaaggaaattcagttcatgaagataagaagtttcttgacaaatacatgccccagttcatga

SEQ ID NO: 14247 - DNA, 208 bp, synthetic construct
  misc_feature 1..208: note = Synthetic polypeptide
  source 1..208: mol_type = other DNA
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaagaaattcagttcatgaagataagaagtttcttgacaaatacatgccccagttcatga

SEQ ID NO: 14248 - DNA, 810 bp, synthetic construct
  misc_feature 1..810: note = Synthetic polypeptide
  source 1..810: mol_type = other DNA
ctgcatcctgccagacctacccatacagacatcaaagtaatgattattgcttattgcctgacctaggatgtgagctccatgagaacagagactgtttacctctcgctcccctgcacctaaaacaatgcctgcttggtgtaaaggcaagccaagtctttgaagactgaagacttgctggcaatggtgataaagctgcagaaagagggaagcctggagccacagatagaggacctgattagccggattaatgatcttcagcaagcaaagaagaaatccagtgaggaactgagagagacccacagtctctgggaggccctgcatagggaattagactccttgaatggagagaaagtgcacctagaggaggtcttgggcaaaaagcaagaggcactgaggatcctccagatgcactgccaagagaaggaaagcgaggctcagaggttggatgtcagaggacagctggaggatctgatgggccagcacaaggacctctgggaattccacatgctggagcagcgactggcccgggagatccgtgccctggagagaagcaaggagcagctgctctcggagaggaggctggtgcgcgccaagctgcgggaggtggagcggcggctgcactcgccgcctgaggtcgagggcgccatggcggtgaatgacgggctgaaggcggagctggagatattcggggagcaggtccggagcgcccccgaggtcggggccggcgagggagaggccggacctgagctcccccgcgctcgcgacgaggaggatcccgagccgccggtggctgcccctgacgccctctag

SEQ ID NO: 14249 - DNA, 531 bp, synthetic construct
  misc_feature 1..531: note = Synthetic polypeptide
  source 1..531: mol_type = other DNA
ggagccctccttatggacctggagaccccagaggagatgcaggctcggagcctgggcaggcccatcaaatcctcaaagcagtacctgcggcaggtcattgcagagtacgaggcactggaccgagaactcccgtgcatccggaagttccccacaccaccagcttcccagcccctctgcctctgcatggagaccttgcccgaggaggattttacccacctggaggtgctgcaagccctggaggcccagttaccaggggccatggagagcgggcgcgtgagcagcatccgctttgagaacatgaacgtcatctgtgggactgctgggcgccggaaccggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctga

SEQ ID NO: 14250 - DNA, 555 bp, synthetic construct
  misc_feature 1..555: note = Synthetic polypeptide
  source 1..555: mol_type = other DNA
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14251 - DNA, 525 bp, synthetic construct
  misc_feature 1..525: note = Synthetic polypeptide
  source 1..525: mol_type = other DNA
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14252 - DNA, 528 bp, synthetic construct
  misc_feature 1..528: note = Synthetic polypeptide
  source 1..528: mol_type = other DNA
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14253 - DNA, 525 bp, synthetic construct
  misc_feature 1..525: note = Synthetic polypeptide
  source 1..525: mol_type = other DNA
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14254 - DNA, 533 bp, synthetic construct
  misc_feature 1..533: note = Synthetic polypeptide
  source 1..533: mol_type = other DNA
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14255 - DNA, 503 bp, synthetic construct
  misc_feature 1..503: note = Synthetic polypeptide
  source 1..503: mol_type = other DNA
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14256 - DNA, 506 bp, synthetic construct
  misc_feature 1..506: note = Synthetic polypeptide
  source 1..506: mol_type = other DNA
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14257 - DNA, 503 bp, synthetic construct
  misc_feature 1..503: note = Synthetic polypeptide
  source 1..503: mol_type = other DNA
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14258 - DNA, 812 bp, synthetic construct; identical to SEQ ID NO: 693
  misc_feature 1..812: note = Synthetic polypeptide
  source 1..812: mol_type = other DNA

SEQ ID NO: 14259 - DNA, 752 bp, synthetic construct; identical to SEQ ID NO: 694
  misc_feature 1..752: note = Synthetic polypeptide
  source 1..752: mol_type = other DNA

SEQ ID NO: 14260 - DNA, 806 bp, synthetic construct
  misc_feature 1..806: note = Synthetic polypeptide
  source 1..806: mol_type = other DNA
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14261 - DNA, 228 bp, synthetic construct
  misc_feature 1..228: note = Synthetic polypeptide
  source 1..228: mol_type = other DNA
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaacttt

SEQ ID NO: 14262 - DNA, 902 bp, synthetic construct
  misc_feature 1..902: note = Synthetic polypeptide
  source 1..902: mol_type = other DNA
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 14263 - DNA, 515 bp, synthetic construct
  misc_feature 1..515: note = Synthetic polypeptide
  source 1..515: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14264 - DNA, 726 bp, synthetic construct
  misc_feature 1..726: note = Synthetic polypeptide
  source 1..726: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14265 - DNA, 213 bp, synthetic construct
  misc_feature 1..213: note = Synthetic polypeptide
  source 1..213: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 14266 - DNA, 568 bp, synthetic construct
  misc_feature 1..568: note = Synthetic polypeptide
  source 1..568: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14267 - DNA, 528 bp, synthetic construct
  misc_feature 1..528: note = Synthetic polypeptide
  source 1..528: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14268 - DNA, 624 bp, synthetic construct
  misc_feature 1..624: note = Synthetic polypeptide
  source 1..624: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14269 - DNA, 315 bp, synthetic construct
  misc_feature 1..315: note = Synthetic polypeptide
  source 1..315: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14270 - DNA, 597 bp, synthetic construct
  misc_feature 1..597: note = Synthetic polypeptide
  source 1..597: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14271 - DNA, 657 bp, synthetic construct
  misc_feature 1..657: note = Synthetic polypeptide
  source 1..657: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14272 - DNA, 744 bp, synthetic construct
  misc_feature 1..744: note = Synthetic polypeptide
  source 1..744: mol_type = other DNA
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14273 - DNA, 433 bp, synthetic construct
  misc_feature 1..433: note = Synthetic polypeptide
  source 1..433: mol_type = other DNA
ggccaggcacagtggctcacgcctgtaatcccagcactttatgaatcccagcattcattagacgaggctgaggcaggtggatcccttgagcctaggagtttgagaccagcctgggcaacatggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataa

SEQ ID NO: 14274 - DNA, 352 bp, synthetic construct
  misc_feature 1..352: note = Synthetic polypeptide
  source 1..352: mol_type = other DNA
caggggacattggcattatctggagacatttttgattgtctggggaaggggcagggagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttag

SEQ ID NO: 14275 - DNA, 436 bp, synthetic construct
  misc_feature 1..436: note = Synthetic polypeptide
  source 1..436: mol_type = other DNA
caggggacattggcattatctggagacatttttgattgtctggggaaggggcagggagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaa

SEQ ID NO: 14276 - DNA, 1389 bp, synthetic construct; identical to SEQ ID NO: 863
  misc_feature 1..1389: note = Synthetic polypeptide
  source 1..1389: mol_type = other DNA

SEQ ID NO: 14277 - DNA, 1244 bp, synthetic construct
  misc_feature 1..1244: note = Synthetic polypeptide
  source 1..1244: mol_type = other DNA
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaa

SEQ ID NO: 14278 - DNA, 971 bp, synthetic construct
  misc_feature 1..971: note = Synthetic polypeptide
  source 1..971: mol_type = other DNA
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagca

SEQ ID NO: 14279 - DNA, 365 bp, synthetic construct
  misc_feature 1..365: note = Synthetic polypeptide
  source 1..365: mol_type = other DNA
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggc

SEQ ID NO: 14280 - DNA, 607 bp, synthetic construct
  misc_feature 1..607: note = Synthetic polypeptide
  source 1..607: mol_type = other DNA
cagaaataaagagaagatcctaaaatcagctagagaagtaaaacagatcacctatcaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctga

SEQ ID NO: 14281 - DNA, 2414 bp, synthetic construct
  misc_feature 1..2414: note = Synthetic polypeptide
  source 1..2414: mol_type = other DNA
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14282 - DNA, 2321 bp, synthetic construct
  misc_feature 1..2321: note = Synthetic polypeptide
  source 1..2321: mol_type = other DNA
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14283 - DNA, 1514 bp, synthetic construct
  misc_feature 1..1514: note = Synthetic polypeptide
  source 1..1514: mol_type = other DNA
tgaagtcaaacagtcctggctatgaatctcagctctgccatttaccaattgtgtgactttggacaagttattttgcttttgagtttccttatcctcgaaaaaagggtgtcatcgtaacttcctgggactgttgtaggaattacacaagacagtgtgcagtagatgcctagtgtgttgggaatacccagtaaatggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactga

SEQ ID NO: 14284 - DNA, 1257 bp, synthetic construct; identical to SEQ ID NO: 625
  misc_feature 1..1257: note = Synthetic polypeptide
  source 1..1257: mol_type = other DNA

SEQ ID NO: 14285 - DNA, 1215 bp, synthetic construct; identical to SEQ ID NO: 626
  misc_feature 1..1215: note = Synthetic polypeptide
  source 1..1215: mol_type = other DNA

SEQ ID NO: 14286 - DNA, 507 bp, synthetic construct; identical to SEQ ID NO: 628
  misc_feature 1..507: note = Synthetic polypeptide
  source 1..507: mol_type = other DNA

SEQ ID NO: 14287 - DNA, 313 bp, synthetic construct; identical to SEQ ID NO: 629
  misc_feature 1..313: note = Synthetic polypeptide
  source 1..313: mol_type = other DNA

SEQ ID NO: 14288 - DNA, 291 bp, synthetic construct; identical to SEQ ID NO: 630
  misc_feature 1..291: note = Synthetic polypeptide
  source 1..291: mol_type = other DNA

SEQ ID NO: 14289 - DNA, 84 bp, synthetic construct
  misc_feature 1..84: note = Synthetic polypeptide
  source 1..84: mol_type = other DNA
gtgttatttgtggggtacagagatgaaagaggggtggtgcattaccggaagtggatcaaggacaccatcgcagccaacccctga

SEQ ID NO: 14290 - DNA, 130 bp, synthetic construct
  misc_feature 1..130: note = Synthetic polypeptide
  source 1..130: mol_type = other DNA
gtgttatttgtggggtacagagatgaaagaggggtggtgcattaccggaagtggatcaaggacaccatcgcagccaacccctgagtgcccctgtcccacccctacctctagtaaatttaagtccacctca

SEQ ID NO: 14291 - DNA, 1118 bp, synthetic construct
  misc_feature 1..1118: note = Synthetic polypeptide
  source 1..1118: mol_type = other DNA
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctga

SEQ ID NO: 14292 - DNA, 959 bp, synthetic construct
  misc_feature 1..959: note = Synthetic polypeptide
  source 1..959: mol_type = other DNA
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctga

SEQ ID NO: 14293 - DNA, 674 bp, synthetic construct
  misc_feature 1..674: note = Synthetic polypeptide
  source 1..674: mol_type = other DNA
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggta

SEQ ID NO: 14294 - DNA, 438 bp, synthetic construct
  misc_feature 1..438: note = Synthetic polypeptide
  source 1..438: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14295 - DNA, 649 bp, synthetic construct
  misc_feature 1..649: note = Synthetic polypeptide
  source 1..649: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14296 - DNA, 136 bp, synthetic construct
  misc_feature 1..136: note = Synthetic polypeptide
  source 1..136: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggccaggtga

SEQ ID NO: 14297 - DNA, 491 bp, synthetic construct
  misc_feature 1..491: note = Synthetic polypeptide
  source 1..491: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14298 - DNA, 547 bp, synthetic construct
  misc_feature 1..547: note = Synthetic polypeptide
  source 1..547: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14299 - DNA, 238 bp, synthetic construct
  misc_feature 1..238: note = Synthetic polypeptide
  source 1..238: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14300 - DNA, 580 bp, synthetic construct
  misc_feature 1..580: note = Synthetic polypeptide
  source 1..580: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14301 - DNA, 667 bp, synthetic construct
  misc_feature 1..667: note = Synthetic polypeptide
  source 1..667: mol_type = other DNA
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14302 - DNA, 2157 bp, synthetic construct
  misc_feature 1..2157: note = Synthetic polypeptide
  source 1..2157: mol_type = other DNA
ggccgggagcggtggctcacacctgtaatcccagcactttgggaggccaaggcaggcggatcacgagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 14303 - DNA, 1970 bp, synthetic construct
  misc_feature 1..1970: note = Synthetic polypeptide
  source 1..1970: mol_type = other DNA
ggccgggagcggtggctcacacctgtaatcccagcactttgggaggccaaggcaggcggatcacgagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaagga

SEQ ID NO: 14304 - DNA, 1518 bp, synthetic construct
  misc_feature 1..1518: note = Synthetic polypeptide
  source 1..1518: mol_type = other DNA
taatgaccttgaattccaagaagaggtaaaaataatgtttaataaaagttgtttcagaagcagtggaatataataaatatcaaatgtgttttcagtgataatggtgaaggtaaaaaagtgttgatgcataaaaggatgtgtatcagtcagctggaaaattcagaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataa

SEQ ID NO: 14305 - DNA, 3502 bp, synthetic construct
  misc_feature 1..3502: note = Synthetic polypeptide
  source 1..3502: mol_type = other DNA
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14306 - DNA, 3643 bp, synthetic construct
  misc_feature 1..3643: note = Synthetic polypeptide
  source 1..3643: mol_type = other DNA
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14307 - DNA, 2245 bp, synthetic construct
  misc_feature 1..2245: note = Synthetic polypeptide
  source 1..2245: mol_type = other DNA
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctag

SEQ ID NO: 14308 - DNA, 1177 bp, synthetic construct
  misc_feature 1..1177: note = Synthetic polypeptide
  source 1..1177: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14309 - DNA, 625 bp, synthetic construct
  misc_feature 1..625: note = Synthetic polypeptide
  source 1..625: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 14310 - DNA, 441 bp, synthetic construct
  misc_feature 1..441: note = Synthetic polypeptide
  source 1..441: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 14311 - DNA, 718 bp, synthetic construct
  misc_feature 1..718: note = Synthetic polypeptide
  source 1..718: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 14312 - DNA, 1213 bp, synthetic construct
  misc_feature 1..1213: note = Synthetic polypeptide
  source 1..1213: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14313 - DNA, 1132 bp, synthetic construct
  misc_feature 1..1132: note = Synthetic polypeptide
  source 1..1132: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14314 - DNA, 895 bp, synthetic construct
  misc_feature 1..895: note = Synthetic polypeptide
  source 1..895: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 14315 - DNA, 811 bp, synthetic construct
  misc_feature 1..811: note = Synthetic polypeptide
  source 1..811: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 14316 - DNA, 874 bp, synthetic construct
  misc_feature 1..874: note = Synthetic polypeptide
  source 1..874: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 14317 - DNA, 3156 bp, synthetic construct
  misc_feature 1..3156: note = Synthetic polypeptide
  source 1..3156: mol_type = other DNA
ggtggcacatgcctgtaatcccagccactcaggaggctgagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 14318 - DNA, 3360 bp, synthetic construct
  misc_feature 1..3360: note = Synthetic polypeptide
  source 1..3360: mol_type = other DNA
ggtggcacatgcctgtaatcccagccactcaggaggctgagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 14319 - DNA, 1433 bp, synthetic construct
  misc_feature 1..1433: note = Synthetic polypeptide
  source 1..1433: mol_type = other DNA
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14320 - DNA, 1277 bp, synthetic construct
  misc_feature 1..1277: note = Synthetic polypeptide
  source 1..1277: mol_type = other DNA
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14321 - DNA, 1403 bp, synthetic construct
  misc_feature 1..1403: note = Synthetic polypeptide
  source 1..1403: mol_type = other DNA
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14322 - DNA, 458 bp, synthetic construct
  misc_feature 1..458: note = Synthetic polypeptide
  source 1..458: mol_type = other DNA
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgt

SEQ ID NO: 14323 - DNA, 413 bp, synthetic construct
  misc_feature 1..413: note = Synthetic polypeptide
  source 1..413: mol_type = other DNA
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgccttt

SEQ ID NO: 14324 - DNA, 2069 bp, synthetic construct
  misc_feature 1..2069: note = Synthetic polypeptide
  source 1..2069: mol_type = other DNA
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14325 - DNA, 1976 bp, synthetic construct
  misc_feature 1..1976: note = Synthetic polypeptide
  source 1..1976: mol_type = other DNA
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14326 - DNA, 414 bp, synthetic construct; identical to SEQ ID NO: 602
  misc_feature 1..414: note = Synthetic polypeptide
  source 1..414: mol_type = other DNA

SEQ ID NO: 14327 - DNA, 434 bp, synthetic construct; identical to SEQ ID NO: 603
  misc_feature 1..434: note = Synthetic polypeptide
  source 1..434: mol_type = other DNA

SEQ ID NO: 14328 - DNA, 560 bp, synthetic construct
  misc_feature 1..560: note = Synthetic polypeptide
  source 1..560: mol_type = other DNA
aaaataccaaggcccagtctctatcagtgtatttacattagaattttgggggatgggacctcatagggtttctttgtttgtttgttttaaagggctccagctgattataaagccaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctga

SEQ ID NO: 14329 - DNA, 1375 bp, synthetic construct
  misc_feature 1..1375: note = Synthetic polypeptide
  source 1..1375: mol_type = other DNA
tagaccataaggccctattctgactgcttcccctgtaggctctgatctctctttccacctctcttccctttattcactccactctaacaactctggtctctgctgttcccatgttccagggatggctctgcctcagggtctgtgccttggctattccttcagcctaggacatccttccctgtggcttgctctatcacctccttcaggtctttgctcaaatggtaattcctcaatgagaccttccggggtgggtcttcacaccattttaaactctcagcacttccattctccctcccttgtcctacttttccttctttcttcacagttcttatgaactcctaacacactggataatctacaaatgtattatgtacattgtttatgcttaatctccctgatttagaagaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaa

SEQ ID NO: 14330 - DNA, 455 bp, synthetic construct
  misc_feature 1..455: note = Synthetic polypeptide
  source 1..455: mol_type = other DNA
gctgggtgtggtggctcatgcctgtaatcccagcactttgggaggctgaggtgggtggatcacctgaggtcaggagtttgagaccagcctggccaacacagtgaaacatcgtccctactaaaaatacagacaattacctgggagtggtgctttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttga

SEQ ID NO: 14331 - DNA, 2249 bp, synthetic construct
  misc_feature 1..2249: note = Synthetic polypeptide
  source 1..2249: mol_type = other DNA
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14332 - DNA, 2156 bp, synthetic construct
  misc_feature 1..2156: note = Synthetic polypeptide
  source 1..2156: mol_type = other DNA
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14333 - DNA, 221 bp, synthetic construct
  misc_feature 1..221: note = Synthetic polypeptide
  source 1..221: mol_type = other DNA
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttataa

SEQ ID NO: 14334 - DNA, 343 bp, synthetic construct
  misc_feature 1..343: note = Synthetic polypeptide
  source 1..343: mol_type = other DNA
ctccaccaccatttctacgtgtctaagtctgtccattcctcaaggcccagtttgctattttctcctccctgaagctcctcctcagaaattttggccagaggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14335 - DNA, 1139 bp, synthetic construct
  misc_feature 1..1139: note = Synthetic polypeptide
  source 1..1139: mol_type = other DNA
aactatgctgctataaagacacatgcacacgtatgtttattgcggcactattcacaatagcaaagacttggaaccaacccaaatgtccaacaatgatagattggattaagaaaatgtggcacatatacaccatggaatactatgcagccataaaaaatgatgagttcatgtcctttgtagggacatggatgaagctggaaaccatcattctcagcaaactatcccaaggacaaaaaacagaacaccgcatgttctcactcatagccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctag

SEQ ID NO: 14336 - DNA, 648 bp, synthetic construct
  misc_feature 1..648: note = Synthetic polypeptide
  source 1..648: mol_type = other DNA
acgcacgcacacacacacacggtgaaacacagacacacacggcttgaaggagagcaaggagaagatggatggagagatagaaaccgagggagggagagagacagcgatcgagagagaccggagaggtggagagcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatga

SEQ ID NO: 14337 - DNA, 164 bp, synthetic construct; identical to SEQ ID NO: 831
  misc_feature 1..164: note = Synthetic polypeptide
  source 1..164: mol_type = other DNA

SEQ ID NO: 14338 - DNA, 193 bp, synthetic construct; identical to SEQ ID NO: 834
  misc_feature 1..193: note = Synthetic polypeptide
  source 1..193: mol_type = other DNA

SEQ ID NO: 14339 - DNA, 560 bp, synthetic construct
  misc_feature 1..560: note = Synthetic polypeptide
  source 1..560: mol_type = other DNA
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctga

SEQ ID NO: 14340 - DNA, 599 bp, synthetic construct
  misc_feature 1..599: note = Synthetic polypeptide
  source 1..599: mol_type = other DNA
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcaaatacaaatctatttcattccaaataaaaaagatgaaagagaaaaattcctaatggataaaagaagaaagattgttgcacattcaaaacagaattcttga

SEQ ID NO: 14341 - DNA, 310 bp, synthetic construct
  misc_feature 1..310: note = Synthetic polypeptide
  source 1..310: mol_type = other DNA
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaa

SEQ ID NO: 14342 - DNA, 1433 bp, synthetic construct
  misc_feature 1..1433: note = Synthetic polypeptide
  source 1..1433: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttag

SEQ ID NO: 14343 - DNA, 1070 bp, synthetic construct
  misc_feature 1..1070: note = Synthetic polypeptide
  source 1..1070: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgattcttgctccgtcacccatgctcgagtgcagtggcgtgatctcggcacactgcagcctctgcttcctgggttcaagtga

SEQ ID NO: 14344 - DNA, 551 bp, synthetic construct
  misc_feature 1..551: note = Synthetic polypeptide
  source 1..551: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttag

SEQ ID NO: 14345 - DNA, 884 bp, synthetic construct
  misc_feature 1..884: note = Synthetic polypeptide
  source 1..884: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttga

SEQ ID NO: 14346 - DNA, 1070 bp, synthetic construct
  misc_feature 1..1070: note = Synthetic polypeptide
  source 1..1070: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctga

SEQ ID NO: 14347 - DNA, 470 bp, synthetic construct
  misc_feature 1..470: note = Synthetic polypeptide
  source 1..470: mol_type = other DNA
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccgg

SEQ ID NO: 14348 - DNA, 576 bp, synthetic construct
  misc_feature 1..576: note = Synthetic polypeptide
  source 1..576: mol_type = other DNA
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttga

SEQ ID NO: 14349 - DNA, 546 bp, synthetic construct
  misc_feature 1..546: note = Synthetic polypeptide
  source 1..546: mol_type = other DNA
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtaa

SEQ ID NO: 14350 - DNA, 252 bp, synthetic construct
  misc_feature 1..252: note = Synthetic polypeptide
  source 1..252: mol_type = other DNA
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatag

SEQ ID NO: 14351 - DNA, 943 bp, synthetic construct
  misc_feature 1..943: note = Synthetic polypeptide
  source 1..943: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14352 - DNA, 391 bp, synthetic construct
  misc_feature 1..391: note = Synthetic polypeptide
  source 1..391: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 14353 - DNA, 207 bp, synthetic construct
  misc_feature 1..207: note = Synthetic polypeptide
  source 1..207: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 14354 - DNA, 484 bp, synthetic construct
  misc_feature 1..484: note = Synthetic polypeptide
  source 1..484: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 14355 - DNA, 979 bp, synthetic construct
  misc_feature 1..979: note = Synthetic polypeptide
  source 1..979: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14356 - DNA, 898 bp, synthetic construct
  misc_feature 1..898: note = Synthetic polypeptide
  source 1..898: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14357 - DNA, 661 bp, synthetic construct
  misc_feature 1..661: note = Synthetic polypeptide
  source 1..661: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 14358 - DNA, 577 bp, synthetic construct
  misc_feature 1..577: note = Synthetic polypeptide
  source 1..577: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 14359 - DNA, 640 bp, synthetic construct
  misc_feature 1..640: note = Synthetic polypeptide
  source 1..640: mol_type = other DNA
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 14360 - DNA, 3067 bp, synthetic construct
  misc_feature 1..3067: note = Synthetic polypeptide
  source 1..3067: mol_type = other DNA
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14361 - DNA, 3064 bp, synthetic construct
  misc_feature 1..3064: note = Synthetic polypeptide
  source 1..3064: mol_type = other DNA
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14362 - DNA, 3100 bp, synthetic construct
  misc_feature 1..3100: note = Synthetic polypeptide
  source 1..3100: mol_type = other DNA
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14363 - DNA, 2236 bp, synthetic construct
  misc_feature 1..2236: note = Synthetic polypeptide
  source 1..2236: mol_type = other DNA
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcataggtctgtcacttccttctctctttgcgattcattaa

SEQ ID NO: 14364 - DNA, 1163 bp, synthetic construct; identical to SEQ ID NO: 13973
  misc_feature 1..1163: note = Synthetic polypeptide
  source 1..1163: mol_type = other DNA

SEQ ID NO: 14365 - DNA, 1229 bp, synthetic construct; identical to SEQ ID NO: 13974
  misc_feature 1..1229: note = Synthetic polypeptide
  source 1..1229: mol_type = other DNA

SEQ ID NO: 14366 - DNA, 553 bp, synthetic construct
  misc_feature 1..553: note = Synthetic polypeptide
  source 1..553: mol_type = other DNA
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14367 - DNA, 523 bp, synthetic construct
  misc_feature 1..523: note = Synthetic polypeptide
  source 1..523: mol_type = other DNA
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14368 - DNA, 526 bp, synthetic construct
  misc_feature 1..526: note = Synthetic polypeptide
  source 1..526: mol_type = other DNA
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14369 - DNA, 523 bp, synthetic construct
  misc_feature 1..523: note = Synthetic polypeptide
  source 1..523: mol_type = other DNA
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14370 - DNA, 1174 bp, synthetic construct
  misc_feature 1..1174: note = Synthetic polypeptide
  source 1..1174: mol_type = other DNA
gtcagctgctagtaccaatggtgaaatgagaaggcactctaagtgagttcttagacatttctgatggattaggaaccagatactggatttgtcagcctgcatctatgacataaacaaatacacaacaaatgcagtgtagagaaataagaaaaggggttgtatgaatttcttcagcaagtctaccagtcgctgcaactatttcttatcagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 14371 - DNA, 469 bp, synthetic construct
  misc_feature 1..469: note = Synthetic polypeptide
  source 1..469: mol_type = other DNA
gtcagctgctagtaccaatggtgaaatgagaaggcactctaagtgagttcttagacatttctgatggattaggaaccagatactggatttgtcagcctgcatctatgacataaacaaatacacaacaaatgcagtgtagagaaataagaaaaggggttgtatgaatttcttcagcaagtctaccagtcgctgcaactatttcttatcagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttga

SEQ ID NO: 14372 - DNA, 1020 bp, synthetic construct
  misc_feature 1..1020: note = Synthetic polypeptide
  source 1..1020: mol_type = other DNA
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatga

SEQ ID NO: 14373 - DNA, 430 bp, synthetic construct
  misc_feature 1..430: note = Synthetic polypeptide
  source 1..430: mol_type = other DNA
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaag

SEQ ID NO: 14374 - DNA, 371 bp, synthetic construct
  misc_feature 1..371: note = Synthetic polypeptide
  source 1..371: mol_type = other DNA
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccag

SEQ ID NO: 14375 - DNA, 282 bp, synthetic construct
  misc_feature 1..282: note = Synthetic polypeptide
  source 1..282: mol_type = other DNA
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaacca

SEQ ID NO: 14376 - DNA, 852 bp, synthetic construct
  misc_feature 1..852: note = Synthetic polypeptide
  source 1..852: mol_type = other DNA
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaa

SEQ ID NO: 14377 - DNA, 852 bp, synthetic construct
  misc_feature 1..852: note = Synthetic polypeptide
  source 1..852: mol_type = other DNA
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaaggtaagtgttatctttatcagcatatgctattattaagctttctcctttttctcttaagcattccatgtttagaatgtaaacattatacaaagatcagagaggtctgtgggagggaagtgaagcagttctgggcctgtttttttcatgctttatcatactgggcctgttgccttcatagataa

SEQ ID NO: 14378 - DNA, 657 bp, synthetic construct
  misc_feature 1..657: note = Synthetic polypeptide
  source 1..657: mol_type = other DNA
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaaataagtggtccccagcactgcagatccgcacagttctgctatcgatccaggccttgttaa

SEQ ID NO: 14379 - DNA, 711 bp, synthetic construct
  misc_feature 1..711: note = Synthetic polypeptide
  source 1..711: mol_type = other DNA
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagctagagcatggactaggctatatgccatgaataatatttaa

SEQ ID NO: 14380 - DNA, 459 bp, synthetic construct; identical to SEQ ID NO: 6625
  misc_feature 1..459: note = Synthetic polypeptide
  source 1..459: mol_type = other DNA

SEQ ID NO: 14381 - DNA, 177 bp, synthetic construct
  misc_feature 1..177: note = Synthetic polypeptide
  source 1..177: mol_type = other DNA
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttag

SEQ ID NO: 14382 - DNA, 1037 bp, synthetic construct
  misc_feature 1..1037: note = Synthetic polypeptide
  source 1..1037: mol_type = other DNA
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattag

SEQ ID NO: 14383 - DNA, 227 bp, synthetic construct
  misc_feature 1..227: note = Synthetic polypeptide
  source 1..227: mol_type = other DNA
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcagcaggtctttcccgcggtgacttcccttgggctgaatga

SEQ ID NO: 14384 - DNA, 376 bp, synthetic construct
  misc_feature 1..376: note = Synthetic polypeptide
  source 1..376: mol_type = other DNA
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagag

SEQ ID NO: 14385 - DNA, 593 bp, synthetic construct
  misc_feature 1..593: note = Synthetic polypeptide
  source 1..593: mol_type = other DNA
caggcatgatggctcgcgcctgtaatctcaacactttggaaggctgaggcagggggattgcttgaggccagaagttcaagaccagcttgggcaacatgatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttgttaaaggtccctggatatgaccagaatatctgctatatttttgggaaggggaccattgagccagtattctatcatggaagtactttataa

SEQ ID NO: 14386 - DNA, 1277 bp, synthetic construct
  misc_feature 1..1277: note = Synthetic polypeptide
  source 1..1277: mol_type = other DNA
caggcatgatggctcgcgcctgtaatctcaacactttggaaggctgaggcagggggattgcttgaggccagaagttcaagaccagcttgggcaacatgatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataa

SEQ ID NO: 14387 - DNA, 345 bp, synthetic construct
  misc_feature 1..345: note = Synthetic polypeptide
  source 1..345: mol_type = other DNA
ggctgggcatggtagctcattcctgtaatcctagcactttgggaggcagagactaggaggcagagactaggcggcagaggcgggtagattgcttgagcttaggagttcaagaccagcctgggcaacatggtgaaaccctctctctacaaaaaaacaaaaattagttgggcgtgttggcttgcgcctgtggtcccagctgcttggaaggctgagtctgaagatgatgagaaactgaaaaagaggaaggagcgatttgggattgtcacaagttcagctggaactggaaccacagaggatacagaggcaaagaagaggaaaagagcagagcgctttgggattgcctga

SEQ ID NO: 14388 - DNA, 354 bp, synthetic construct
  misc_feature 1..354: note = Synthetic polypeptide
  source 1..354: mol_type = other DNA
ggctgggcatggtagctcattcctgtaatcctagcactttgggaggcagagactaggaggcagagactaggcggcagaggcgggtagattgcttgagcttaggagttcaagaccagcctgggcaacatggtgaaaccctctctctacaaaaaaacaaaaattagttgggcgtgttggcttgcgcctgtggtcccagctgcttggaaggctgagtctgaagatgatgagaaactgaaaaagaggaaggagcgatttgggattgtcacaagttcagctggaactggaaccacagaggatacagaggtaaaaatatacctggaacgcttcatagaccttgaagggaaattagagtga

SEQ ID NO: 14389 - DNA, 438 bp, synthetic construct
  misc_feature 1..438: note = Synthetic polypeptide
  source 1..438: mol_type = other DNA
ggccaggcacagtggttcacgcctatgatcccagcactttaggaggccaagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataa

SEQ ID NO: 14390 - DNA, 480 bp, synthetic construct
  misc_feature 1..480: note = Synthetic polypeptide
  source 1..480: mol_type = other DNA
ggccaggcacagtggttcacgcctatgatcccagcactttaggaggccaagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcggcacttgtttgcaggatccaaaagctgctctgctattctggaagccacagtcaagggacccaggacccgagcagctggcagaaggacttgtaccttctgtttgtcccattgtatccaagatgttaa

SEQ ID NO: 14391 - DNA, 1406 bp, synthetic construct
  misc_feature 1..1406: note = Synthetic polypeptide
  source 1..1406: mol_type = other DNA
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14392 - DNA, 1370 bp, synthetic construct
  misc_feature 1..1370: note = Synthetic polypeptide
  source 1..1370: mol_type = other DNA
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14393 - DNA, 1319 bp, synthetic construct
  misc_feature 1..1319: note = Synthetic polypeptide
  source 1..1319: mol_type = other DNA
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14394 - DNA, 1184 bp, synthetic construct
  misc_feature 1..1184: note = Synthetic polypeptide
  source 1..1184: mol_type = other DNA
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14395 - DNA, 1114 bp, synthetic construct; identical to SEQ ID NO: 9614
  misc_feature 1..1114: note = Synthetic polypeptide
  source 1..1114: mol_type = other DNA

SEQ ID NO: 14396 - DNA, 944 bp, synthetic construct
  misc_feature 1..944: note = Synthetic polypeptide
  source 1..944: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14397 - DNA, 431 bp, synthetic construct
  misc_feature 1..431: note = Synthetic polypeptide
  source 1..431: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 14398 - DNA, 746 bp, synthetic construct
  misc_feature 1..746: note = Synthetic polypeptide
  source 1..746: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14399 - DNA, 842 bp, synthetic construct
  misc_feature 1..842: note = Synthetic polypeptide
  source 1..842: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14400 - DNA, 533 bp, synthetic construct
  misc_feature 1..533: note = Synthetic polypeptide
  source 1..533: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14401 - DNA, 815 bp, synthetic construct
  misc_feature 1..815: note = Synthetic polypeptide
  source 1..815: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14402 - DNA, 875 bp, synthetic construct
  misc_feature 1..875: note = Synthetic polypeptide
  source 1..875: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14403 - DNA, 962 bp, synthetic construct
  misc_feature 1..962: note = Synthetic polypeptide
  source 1..962: mol_type = other DNA
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14404 - DNA, 829 bp, synthetic construct; identical to SEQ ID NO: 8675
  misc_feature 1..829: note = Synthetic polypeptide
  source 1..829: mol_type = other DNA

SEQ ID NO: 14405 - DNA, 1001 bp, synthetic construct
  misc_feature 1..1001: note = Synthetic polypeptide
  source 1..1001: mol_type = other DNA
ttaggaaagggatctggccagctctgctagagacactgtgcaactttagtcaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14406 - DNA, 196 bp, synthetic construct
  misc_feature 1..196: note = Synthetic polypeptide
  source 1..196: mol_type = other DNA
gagatcctggggatgttagggaaagggattgtttcttttccttcgctctatcccagggcaggacagtatcaggcacttagtcagctctagatatggaaaacgatccagcccagagacactgatttcagacctcttgatgagagaaagcacagaaaatgttcccagaactcggcttgaagaccctgcaatgtggtga

SEQ ID NO: 14407 - DNA, 535 bp, synthetic construct; identical to SEQ ID NO: 10018
  misc_feature 1..535: note = Synthetic polypeptide
  source 1..535: mol_type = other DNA

SEQ ID NO: 14408 - DNA, 1442 bp, synthetic construct
  misc_feature 1..1442: note = Synthetic polypeptide
  source 1..1442: mol_type = other DNA
gatggggtcagaaacaggatctgaagtagagcttcttctaatgacccccaggggtgctgagtgatcaagcaaggtacctgcaggacccatttgtgtccattgatctcttggagcagctggggatcatggtaagttcttgctcagatttcagaactccatggatttgtgctttgagctctccgagtttctttgaggaaatttctgttccaaactgggtttggaaatcacaacagaaattggactgggtccgggattgaattagatctggtaattaactggcttggatccagttaaggcctcttacaactgactgggtcagaaagaaactggtagtaaatggtaatattgcagggggtgtaaaatttgggttttggaaattcacagggatttttgtttttcacccctttgtttcatttttcttcagtgcttacacaggaaaaaaaatcattggctaagttaatcaagggaacccgagagcaaacccaatatcctaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14409 - DNA, 1346 bp, synthetic construct; identical to SEQ ID NO: 7758
  misc_feature 1..1346: note = Synthetic polypeptide
  source 1..1346: mol_type = other DNA

SEQ ID NO: 14410 - DNA, 401 bp, synthetic construct
  misc_feature 1..401: note = Synthetic polypeptide
  source 1..401: mol_type = other DNA
attttttatcttttatagagtacttttagtgtgccttttctatgtctagatgtgtttatatatacaaatatttaccattgtgttataattgcctacagtattcagtacagtgcaggtttgtactgtacaggtttgtagccgaggagcaataacctataccatgaagcctaggtgtgtagtaggctacaccgtctatgtttggaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattga

SEQ ID NO: 14411 - DNA, 1004 bp, synthetic construct
  misc_feature 1..1004: note = Synthetic polypeptide
  source 1..1004: mol_type = other DNA
ttttctactcattgttgattgcctgatggtcttcatgagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 14412 - DNA, 299 bp, synthetic construct
  misc_feature 1..299: note = Synthetic polypeptide
  source 1..299: mol_type = other DNA
ttttctactcattgttgattgcctgatggtcttcatgagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttga

SEQ ID NO: 14413 - DNA, 959 bp, synthetic construct
  misc_feature 1..959: note = Synthetic polypeptide
  source 1..959: mol_type = other DNA
cagtggatctcaaccaggggcagttttgccccagaggacgtttgtcagtgacatttttggtggtatcattttgggagtgtgctcctggtatctatgcagtagggtccagggatgctagcgaacctcccacaatgcctggggcagcttccaaaatgaagaagtatccagctcagaaggtcatcagtgctgaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14414 - DNA, 1946 bp, synthetic construct; identical to SEQ ID NO: 7119
  misc_feature 1..1946: note = Synthetic polypeptide
  source 1..1946: mol_type = other DNA

SEQ ID NO: 14415 - DNA, 1565 bp, synthetic construct
  misc_feature 1..1565: note = Synthetic polypeptide
  source 1..1565: mol_type = other DNA
aaagaatatgactgcattatttgatgttttactactaaaagcttttaaggttcactcttgtcttttcttgtacccttaatctgggcagtatgataaaaaaaaaagccagagtgctcccacctttggtgccaggggagattcaaatcacacaaacctcaaccttcatgcaggaaggctcacaccagcctaccccctaaccacaatgaaaccctaagacctgtctcttttcactgttttctcaagtcattttcagatcagcttgagaggactgcccttctttccccagagaagtctcattgtgtatgaaataaacctcttcataccctctcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatga

SEQ ID NO: 14416 - DNA, 330 bp, synthetic construct
  misc_feature 1..330: note = Synthetic polypeptide
  source 1..330: mol_type = other DNA
tctctctgctcccgcctccttatcctctctcactttgccgagataattccccctcttcttttggatctcaattcagtcaccactcctcaggaaaacctttcctgacctctctaactaggtctgatccttatgtttcactctgaggatactgtgcacctctcatttatagcatttttttataggtggaattttatatttatttgattgtctccttattagacccttagctccattagggagcaagtttgtctggactcagtctcaccccagcacttaggtgcttgcactctgatctacaaatttggaagaaccgaagagctatggacctga

SEQ ID NO: 14417 - DNA, 305 bp, synthetic construct; identical to SEQ ID NO: 13125
  misc_feature 1..305: note = Synthetic polypeptide
  source 1..305: mol_type = other DNA

SEQ ID NO: 14418 - DNA, 122 bp, synthetic construct
  misc_feature 1..122: note = Synthetic polypeptide
  source 1..122: mol_type = other DNA
gccagttgtttgagaacttctactttggctccctaaagctgaattcaattcacatctctcagaggttcaccgtagacagctttggaaactacgcttcctgtggacaaattgacttctcctga

SEQ ID NO: 14419 - DNA, 13 bp, synthetic construct
  misc_feature 1..13: note = Synthetic polypeptide
  source 1..13: mol_type = other DNA
gccagttgtttga

SEQ ID NO: 14420 - DNA, 163 bp, synthetic construct; identical to SEQ ID NO: 480
  misc_feature 1..163: note = Synthetic polypeptide
  source 1..163: mol_type = other DNA

SEQ ID NO: 14421 - DNA, 104 bp, synthetic construct; identical to SEQ ID NO: 481
  misc_feature 1..104: note = Synthetic polypeptide
  source 1..104: mol_type = other DNA

SEQ ID NO: 14422 - DNA, 820 bp, synthetic construct; identical to SEQ ID NO: 7641
  misc_feature 1..820: note = Synthetic polypeptide
  source 1..820: mol_type = other DNA

SEQ ID NO: 14423 - DNA, 946 bp, synthetic construct; identical to SEQ ID NO: 7642
  misc_feature 1..946: note = Synthetic polypeptide
  source 1..946: mol_type = other DNA

SEQ ID NO: 14424 - DNA, 382 bp, synthetic construct; identical to SEQ ID NO: 434
  misc_feature 1..382: note = Synthetic polypeptide
  source 1..382: mol_type = other DNA

SEQ ID NO: 14425 - DNA, 999 bp, synthetic construct; identical to SEQ ID NO: 7664
  misc_feature 1..999: note = Synthetic polypeptide
  source 1..999: mol_type = other DNA

SEQ ID NO: 14426 - DNA, 1267 bp, synthetic construct; identical to SEQ ID NO: 463
  misc_feature 1..1267: note = Synthetic polypeptide
  source 1..1267: mol_type = other DNA

SEQ ID NO: 14427 - DNA, 1086 bp, synthetic construct; identical to SEQ ID NO: 6423
  misc_feature 1..1086: note = Synthetic polypeptide
  source 1..1086: mol_type = other DNA

SEQ ID NO: 14428 - DNA, 2419 bp, synthetic construct; identical to SEQ ID NO: 7455
  misc_feature 1..2419: note = Synthetic polypeptide
  source 1..2419: mol_type = other DNA

SEQ ID NO: 14429 - DNA, 527 bp, synthetic construct; identical to SEQ ID NO: 7665
  misc_feature 1..527: note = Synthetic polypeptide
  source 1..527: mol_type = other DNA

SEQ ID NO: 14430 - DNA, 1086 bp, synthetic construct; identical to SEQ ID NO: 444
  misc_feature 1..1086: note = Synthetic polypeptide
  source 1..1086: mol_type = other DNA

SEQ ID NO: 14431 - DNA, 564 bp, synthetic construct; identical to SEQ ID NO: 445
  misc_feature 1..564: note = Synthetic polypeptide
  source 1..564: mol_type = other DNA

SEQ ID NO: 14432 - DNA, 987 bp, synthetic construct; identical to SEQ ID NO: 446
  misc_feature 1..987: note = Synthetic polypeptide
  source 1..987: mol_type = other DNA

SEQ ID NO: 14433 - DNA, 1138 bp, synthetic construct; identical to SEQ ID NO: 7655
  misc_feature 1..1138: note = Synthetic polypeptide
  source 1..1138: mol_type = other DNA

SEQ ID NO: 14434 - DNA, 470 bp, synthetic construct; identical to SEQ ID NO: 7659
  misc_feature 1..470: note = Synthetic polypeptide
  source 1..470: mol_type = other DNA

SEQ ID NO: 14435 - DNA, 611 bp, synthetic construct; identical to SEQ ID NO: 7660
  misc_feature 1..611: note = Synthetic polypeptide
  source 1..611: mol_type = other DNA

SEQ ID NO: 14436 - DNA, 347 bp, synthetic construct; identical to SEQ ID NO: 7661
  misc_feature 1..347: note = Synthetic polypeptide
  source 1..347: mol_type = other DNA

SEQ ID NO: 14437 - DNA, 366 bp, synthetic construct; identical to SEQ ID NO: 7663
  misc_feature 1..366: note = Synthetic polypeptide
  source 1..366: mol_type = other DNA

SEQ ID NO: 14438 - DNA, 451 bp, synthetic construct; identical to SEQ ID NO: 7666
  misc_feature 1..451: note = Synthetic polypeptide
  source 1..451: mol_type = other DNA

SEQ ID NO: 14439 - DNA, 161 bp, synthetic construct; identical to SEQ ID NO: 7668
  misc_feature 1..161: note = Synthetic polypeptide
  source 1..161: mol_type = other DNA

SEQ ID NO: 14440 - DNA, 178 bp, synthetic construct; identical to SEQ ID NO: 7669
  misc_feature 1..178: note = Synthetic polypeptide
  source 1..178: mol_type = other DNA

SEQ ID NO: 14441 - DNA, 2319 bp, synthetic construct; identical to SEQ ID NO: 6366
  misc_feature 1..2319: note = Synthetic polypeptide
  source 1..2319: mol_type = other DNA

SEQ ID NO: 14442 - DNA, 2564 bp, synthetic construct; identical to SEQ ID NO: 7690
  misc_feature 1..2564: note = Synthetic polypeptide
  source 1..2564: mol_type = other DNA

SEQ ID NO: 14443 - DNA, 1448 bp, synthetic construct; identical to SEQ ID NO: 7691
  misc_feature 1..1448: note = Synthetic polypeptide
  source 1..1448: mol_type = other DNA

SEQ ID NO: 14444 - DNA, 2417 bp, synthetic construct; identical to SEQ ID NO: 7692
  misc_feature 1..2417: note = Synthetic polypeptide
  source 1..2417: mol_type = other DNA

SEQ ID NO: 14445 - DNA, 1206 bp, synthetic construct; identical to SEQ ID NO: 7670
  misc_feature 1..1206: note = Synthetic polypeptide
  source 1..1206: mol_type = other DNA

SEQ ID NO: 14446 - DNA, 1134 bp, synthetic construct; identical to SEQ ID NO: 7671
  misc_feature 1..1134: note = Synthetic polypeptide
  source 1..1134: mol_type = other DNA

SEQ ID NO: 14447 - DNA, 1002 bp, synthetic construct; identical to SEQ ID NO: 7672
  misc_feature 1..1002: note = Synthetic polypeptide
  source 1..1002: mol_type = other DNA

SEQ ID NO: 14448 - DNA, 279 bp, synthetic construct; identical to SEQ ID NO: 7673
  misc_feature 1..279: note = Synthetic polypeptide
  source 1..279: mol_type = other DNA

SEQ ID NO: 14449 - DNA, 1983 bp, synthetic construct; identical to SEQ ID NO: 7685
  misc_feature 1..1983: note = Synthetic polypeptide
  source 1..1983: mol_type = other DNA

SEQ ID NO: 14450 - DNA, 192 bp, synthetic construct; identical to SEQ ID NO: 8269
  misc_feature 1..192: note = Synthetic polypeptide
  source 1..192: mol_type = other DNA

SEQ ID NO: 14451 - DNA, 3021 bp, synthetic construct; identical to SEQ ID NO: 449
  misc_feature 1..3021: note = Synthetic polypeptide
  source 1..3021: mol_type = other DNA

SEQ ID NO: 14452 - DNA, 3075 bp, synthetic construct; identical to SEQ ID NO: 450
  misc_feature 1..3075: note = Synthetic polypeptide
  source 1..3075: mol_type = other DNA

SEQ ID NO: 14453 - DNA, 1143 bp, synthetic construct; identical to SEQ ID NO: 451
  misc_feature 1..1143: note = Synthetic polypeptide
  source 1..1143: mol_type = other DNA

SEQ ID NO: 14454 - DNA, 1111 bp, synthetic construct
  misc_feature 1..1111: note = Synthetic polypeptide
  source 1..1111: mol_type = other DNA
ccgggcatggtggctcacacccgtaatcccagcactttgagaggccaaggcgggcagatcacttgaggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtga

SEQ ID NO: 14455 - DNA, 333 bp, synthetic construct; identical to SEQ ID NO: 6583
  misc_feature 1..333: note = Synthetic polypeptide
  source 1..333: mol_type = other DNA

SEQ ID NO: 14456 - DNA, 629 bp, synthetic construct; identical to SEQ ID NO: 7943
  misc_feature 1..629: note = Synthetic polypeptide
  source 1..629: mol_type = other DNA

SEQ ID NO: 14457 - DNA, 472 bp, synthetic construct; identical to SEQ ID NO: 7944
  misc_feature 1..472: note = Synthetic polypeptide
  source 1..472: mol_type = other DNA

SEQ ID NO: 14458 - DNA, 567 bp, synthetic construct; identical to SEQ ID NO: 7689
  misc_feature 1..567: note = Synthetic polypeptide
  source 1..567: mol_type = other DNA

SEQ ID NO: 14459 - DNA, 1926 bp, synthetic construct; identical to SEQ ID NO: 7679
  misc_feature 1..1926: note = Synthetic polypeptide
  source 1..1926: mol_type = other DNA

SEQ ID NO: 14460 - DNA, 477 bp, synthetic construct; identical to SEQ ID NO: 7680
  misc_feature 1..477: note = Synthetic polypeptide
  source 1..477: mol_type = other DNA

SEQ ID NO: 14461 - DNA, 711 bp, synthetic construct; identical to SEQ ID NO: 7681
  misc_feature 1..711: note = Synthetic polypeptide
  source 1..711: mol_type = other DNA

SEQ ID NO: 14462 - DNA, 288 bp, synthetic construct; identical to SEQ ID NO: 7682
  misc_feature 1..288: note = Synthetic polypeptide
  source 1..288: mol_type = other DNA

SEQ ID NO: 14463 - DNA, 237 bp, synthetic construct; identical to SEQ ID NO: 7683
  misc_feature 1..237: note = Synthetic polypeptide
  source 1..237: mol_type = other DNA

SEQ ID NO: 14464 - DNA, 703 bp, synthetic construct; identical to SEQ ID NO: 7684
  misc_feature 1..703: note = Synthetic polypeptide
  source 1..703: mol_type = other DNA

SEQ ID NO: 14465 - DNA, 851 bp, synthetic construct
  misc_feature 1..851: note = Synthetic polypeptide
  source 1..851: mol_type = other DNA
caggggtcccaatccgtgagccgcagaccagtaactgtctgtggtttgtgagaaacgaggccacacagcaggaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttga

SEQ ID NO: 14466 - DNA, 449 bp, synthetic construct
  misc_feature 1..449: note = Synthetic polypeptide
  source 1..449: mol_type = other DNA
caggggtcccaatccgtgagccgcagaccagtaactgtctgtggtttgtgagaaacgaggccacacagcaggaggcccggggctcaagcccagtgtcactagacctcatcattcccttcctgaggccagggtgctgtgtcctgctccatgcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctga

SEQ ID NO: 14467 - DNA, 545 bp, synthetic construct; identical to SEQ ID NO: 7336
  misc_feature 1..545: note = Synthetic polypeptide
  source 1..545: mol_type = other DNA

SEQ ID NO: 14468 - DNA, 1029 bp, synthetic construct; identical to SEQ ID NO: 8732
  misc_feature 1..1029: note = Synthetic polypeptide
  source 1..1029: mol_type = other DNA

SEQ ID NO: 14469 - DNA, 1170 bp, synthetic construct; identical to SEQ ID NO: 8733
  misc_feature 1..1170: note = Synthetic polypeptide
  source 1..1170: mol_type = other DNA

SEQ ID NO: 14470 - DNA, 1062 bp, synthetic construct; identical to SEQ ID NO: 8734
  misc_feature 1..1062: note = Synthetic polypeptide
  source 1..1062: mol_type = other DNA

SEQ ID NO: 14471 - DNA, 573 bp, synthetic construct; identical to SEQ ID NO: 8735
  misc_feature 1..573: note = Synthetic polypeptide
  source 1..573: mol_type = other DNA

SEQ ID NO: 14472 - DNA, 299 bp, synthetic construct; identical to SEQ ID NO: 8736
  misc_feature 1..299: note = Synthetic polypeptide
  source 1..299: mol_type = other DNA

SEQ ID NO: 14473 - DNA, 330 bp, synthetic construct; identical to SEQ ID NO: 6490
  misc_feature 1..330: note = Synthetic polypeptide
  source 1..330: mol_type = other DNA

SEQ ID NO: 14474 - DNA, 342 bp, synthetic construct; identical to SEQ ID NO: 7076
  misc_feature 1..342: note = Synthetic polypeptide
  source 1..342: mol_type = other DNA

SEQ ID NO: 14475 - DNA, 1516 bp, synthetic construct; identical to SEQ ID NO: 7077
  misc_feature 1..1516: note = Synthetic polypeptide
  source 1..1516: mol_type = other DNA

SEQ ID NO: 14476 - DNA, 1444 bp, synthetic construct; identical to SEQ ID NO: 7078
  misc_feature 1..1444: note = Synthetic polypeptide
  source 1..1444: mol_type = other DNA

SEQ ID NO: 14477 - DNA, 1312 bp, synthetic construct; identical to SEQ ID NO: 7079
  misc_feature 1..1312: note = Synthetic polypeptide
  source 1..1312: mol_type = other DNA

SEQ ID NO: 14478 - DNA, 1609 bp, synthetic construct; identical to SEQ ID NO: 7721
  misc_feature 1..1609: note = Synthetic polypeptide
  source 1..1609: mol_type = other DNA

SEQ ID NO: 14479 - DNA, 1525 bp, synthetic construct; identical to SEQ ID NO: 7722
  misc_feature 1..1525: note = Synthetic polypeptide
  source 1..1525: mol_type = other DNA

SEQ ID NO: 14480 - DNA, 436 bp, synthetic construct; identical to SEQ ID NO: 7723
  misc_feature 1..436: note = Synthetic polypeptide
  source 1..436: mol_type = other DNA

SEQ ID NO: 14481 - DNA, 1883 bp, synthetic construct; identical to SEQ ID NO: 6345
  misc_feature 1..1883: note = Synthetic polypeptide
  source 1..1883: mol_type = other DNA

SEQ ID NO: 14482 - DNA, 404 bp, synthetic construct; identical to SEQ ID NO: 7701
  misc_feature 1..404: note = Synthetic polypeptide
  source 1..404: mol_type = other DNA

SEQ ID NO: 14483 - DNA, 336 bp, synthetic construct; identical to SEQ ID NO: 7702
  misc_feature 1..336: note = Synthetic polypeptide
  source 1..336: mol_type = other DNA

SEQ ID NO: 14484 - DNA, 3325 bp, synthetic construct; identical to SEQ ID NO: 7703
  misc_feature 1..3325: note = Synthetic polypeptide
  source 1..3325: mol_type = other DNA

SEQ ID NO: 14485 - DNA, 169 bp, synthetic construct; identical to SEQ ID NO: 7704
  misc_feature 1..169: note = Synthetic polypeptide
  source 1..169: mol_type = other DNA

SEQ ID NO: 14486 - DNA, 169 bp, synthetic construct; identical to SEQ ID NO: 7705
  misc_feature 1..169: note = Synthetic polypeptide
  source 1..169: mol_type = other DNA

SEQ ID NO: 14487 - DNA, 241 bp, synthetic construct; identical to SEQ ID NO: 7706
  misc_feature 1..241: note = Synthetic polypeptide
  source 1..241: mol_type = other DNA

SEQ ID NO: 14488 - DNA, 273 bp, synthetic construct; identical to SEQ ID NO: 7707
  misc_feature 1..273: note = Synthetic polypeptide
  source 1..273: mol_type = other DNA

SEQ ID NO: 14489 - DNA, 329 bp, synthetic construct; identical to SEQ ID NO: 7708
  misc_feature 1..329: note = Synthetic polypeptide
  source 1..329: mol_type = other DNA

SEQ ID NO: 14490 - DNA, 203 bp, synthetic construct; identical to SEQ ID NO: 7709
  misc_feature 1..203: note = Synthetic polypeptide
  source 1..203: mol_type = other DNA

SEQ ID NO: 14491 - DNA, 271 bp, synthetic construct; identical to SEQ ID NO: 7710
  misc_feature 1..271: note = Synthetic polypeptide
  source 1..271: mol_type = other DNA

SEQ ID NO: 14492 - DNA, 297 bp, synthetic construct; identical to SEQ ID NO: 7711
  misc_feature 1..297: note = Synthetic polypeptide
  source 1..297: mol_type = other DNA

SEQ ID NO: 14493 - DNA, 127 bp, synthetic construct; identical to SEQ ID NO: 7712
  misc_feature 1..127: note = Synthetic polypeptide
  source 1..127: mol_type = other DNA

SEQ ID NO: 14494 - DNA, 1325 bp, synthetic construct; identical to SEQ ID NO: 7686
  misc_feature 1..1325: note = Synthetic polypeptide
  source 1..1325: mol_type = other DNA

SEQ ID NO: 14495 - DNA, 1691 bp, synthetic construct; identical to SEQ ID NO: 7687
  misc_feature 1..1691: note = Synthetic polypeptide
  source 1..1691: mol_type = other DNA

SEQ ID NO: 14496 - DNA, 1541 bp, synthetic construct; identical to SEQ ID NO: 7688
  misc_feature 1..1541: note = Synthetic polypeptide
  source 1..1541: mol_type = other DNA

SEQ ID NO: 14497 - DNA, 873 bp, synthetic construct; identical to SEQ ID NO: 8120
  misc_feature 1..873: note = Synthetic polypeptide
  source 1..873: mol_type = other DNA

SEQ ID NO: 14498 - DNA, 921 bp, synthetic construct; identical to SEQ ID NO: 8121
  misc_feature 1..921: note = Synthetic polypeptide
  source 1..921: mol_type = other DNA

SEQ ID NO: 14499 - DNA, 1717 bp, synthetic construct
  misc_feature 1..1717: note = Synthetic polypeptide
  source 1..1717: mol_type = other DNA
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtga

SEQ ID NO: 14500 - DNA, 502 bp, synthetic construct
  misc_feature 1..502: note = Synthetic polypeptide
  source 1..502: mol_type = other DNA
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagtacaaccggcacgacagccccgaagatgtgaagcgacgagccatggccgaccctga

SEQ ID NO: 14501 - DNA, 1645 bp, synthetic construct
  misc_feature 1..1645: note = Synthetic polypeptide
  source 1..1645: mol_type = other DNA
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtga

SEQ ID NO: 14502 - DNA, 796 bp, synthetic construct
  misc_feature 1..796: note = Synthetic polypeptide
  source 1..796: mol_type = other DNA
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataa

SEQ ID NO: 14503 - DNA, 978 bp, synthetic construct
  misc_feature 1..978: note = Synthetic polypeptide
  source 1..978: mol_type = other DNA
ataaaaacaatcagatacagtttccttcaagtggcagggtcagtaatagcctttaactgttttatctcaaggctctatttagctggttttctatcataatatattttggaagaactttagtcatcttgaaacaaagctggtattacattaatgacatctggttgttctccgtggataggaattataaagccctctagatgcctcagtatgacaatatgacacatgcatcccagaccaatataaaatctgcaaagttcaggaaccttctatactgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaa

SEQ ID NO: 14504 - DNA, 731 bp, synthetic construct
  misc_feature 1..731: note = Synthetic polypeptide
  source 1..731: mol_type = other DNA
ataaaaacaatcagatacagtttccttcaagtggcagggtcagtaatagcctttaactgttttatctcaaggctctatttagctggttttctatcataatatattttggaagaactttagtcatcttgaaacaaagctggtattacattaatgacatctggttgttctccgtggataggaattataaagccctctagatgcctcagtatgacaatatgacacatgcatcccagaccaatataaaatctgcaaagttcaggaaccttctatactgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 14505 - DNA, 1461 bp, synthetic construct; identical to SEQ ID NO: 7696
  misc_feature 1..1461: note = Synthetic polypeptide
  source 1..1461: mol_type = other DNA

SEQ ID NO: 14506 - DNA, 369 bp, synthetic construct; identical to SEQ ID NO: 6429
  misc_feature 1..369: note = Synthetic polypeptide
  source 1..369: mol_type = other DNA

SEQ ID NO: 14507 - DNA, 201 bp, synthetic construct; identical to SEQ ID NO: 6430
  misc_feature 1..201: note = Synthetic polypeptide
  source 1..201: mol_type = other DNA

SEQ ID NO: 14508 - DNA, 1238 bp, synthetic construct; identical to SEQ ID NO: 7778
  misc_feature 1..1238: note = Synthetic polypeptide
  source 1..1238: mol_type = other DNA

SEQ ID NO: 14509 - DNA, 1085 bp, synthetic construct; identical to SEQ ID NO: 7779
  misc_feature 1..1085: note = Synthetic polypeptide
  source 1..1085: mol_type = other DNA

SEQ ID NO: 14510 - DNA, 455 bp, synthetic construct; identical to SEQ ID NO: 7734
  misc_feature 1..455: note = Synthetic polypeptide
  source 1..455: mol_type = other DNA

SEQ ID NO: 14511 - DNA, 295 bp, synthetic construct; identical to SEQ ID NO: 7744
  misc_feature 1..295: note = Synthetic polypeptide
  source 1..295: mol_type = other DNA

SEQ ID NO: 14512 - DNA, 286 bp, synthetic construct; identical to SEQ ID NO: 7745
  misc_feature 1..286: note = Synthetic polypeptide
  source 1..286: mol_type = other DNA

SEQ ID NO: 14513 - DNA, 3541 bp, synthetic construct; identical to SEQ ID NO: 7746
  misc_feature 1..3541: note = Synthetic polypeptide
  source 1..3541: mol_type = other DNA

SEQ ID NO: 14514 - DNA, 3520 bp, synthetic construct; identical to SEQ ID NO: 7747
  misc_feature 1..3520: note = Synthetic polypeptide
  source 1..3520: mol_type = other DNA

SEQ ID NO: 14515 - DNA, 200 bp, synthetic construct; identical to SEQ ID NO: 7748
  misc_feature 1..200: note = Synthetic polypeptide
  source 1..200: mol_type = other DNA

SEQ ID NO: 14516 - DNA, 135 bp, synthetic construct; identical to SEQ ID NO: 7749
  misc_feature 1..135: note = Synthetic polypeptide
  source 1..135: mol_type = other DNA

SEQ ID NO: 14517 - DNA, 3484 bp, synthetic construct; identical to SEQ ID NO: 7750
  misc_feature 1..3484: note = Synthetic polypeptide
  source 1..3484: mol_type = other DNA

SEQ ID NO: 14518 - DNA, 311 bp, synthetic construct; identical to SEQ ID NO: 7757
  misc_feature 1..311: note = Synthetic polypeptide
  source 1..311: mol_type = other DNA

SEQ ID NO: 14519 - DNA, 1346 bp, synthetic construct; identical to SEQ ID NO: 7758
  misc_feature 1..1346: note = Synthetic polypeptide
  source 1..1346: mol_type = other DNA

SEQ ID NO: 14520 - DNA, 1508 bp, synthetic construct; identical to SEQ ID NO: 7729
  misc_feature 1..1508: note = Synthetic polypeptide
  source 1..1508: mol_type = other DNA

SEQ ID NO: 14521 - DNA, 603 bp, synthetic construct; identical to SEQ ID NO: 7730
  misc_feature 1..603: note = Synthetic polypeptide
  source 1..603: mol_type = other DNA

SEQ ID NO: 14522 - DNA, 909 bp, synthetic construct; identical to SEQ ID NO: 7731
  misc_feature 1..909: note = Synthetic polypeptide
  source 1..909: mol_type = other DNA

SEQ ID NO: 14523 - DNA, 807 bp, synthetic construct; identical to SEQ ID NO: 7401
  misc_feature 1..807: note = Synthetic polypeptide
  source 1..807: mol_type = other DNA

SEQ ID NO: 14524 - DNA, 453 bp, synthetic construct; identical to SEQ ID NO: 7402
  misc_feature 1..453: note = Synthetic polypeptide
  source 1..453: mol_type = other DNA

SEQ ID NO: 14525 - DNA, 382 bp, synthetic construct; identical to SEQ ID NO: 434
  misc_feature 1..382: note = Synthetic polypeptide
  source 1..382: mol_type = other DNA

SEQ ID NO: 14526 - DNA, 529 bp, synthetic construct; identical to SEQ ID NO: 12735
  misc_feature 1..529: note = Synthetic polypeptide
  source 1..529: mol_type = other DNA

SEQ ID NO: 14527 - DNA, 1317 bp, synthetic construct; identical to SEQ ID NO: 12736
  misc_feature 1..1317: note = Synthetic polypeptide
  source 1..1317: mol_type = other DNA

SEQ ID NO: 14528 - DNA, 1221 bp, synthetic construct; identical to SEQ ID NO: 12737
  misc_feature 1..1221: note = Synthetic polypeptide
  source 1..1221: mol_type = other DNA

SEQ ID NO: 14529 - DNA, 1200 bp, synthetic construct; identical to SEQ ID NO: 12738
  misc_feature 1..1200: note = Synthetic polypeptide
  source 1..1200: mol_type = other DNA

SEQ ID NO: 14530 - DNA, 922 bp, synthetic construct; identical to SEQ ID NO: 12739
  misc_feature 1..922: note = Synthetic polypeptide
  source 1..922: mol_type = other DNA

SEQ ID NO: 14531 - DNA, 632 bp, synthetic construct; identical to SEQ ID NO: 12740
  misc_feature 1..632: note = Synthetic polypeptide
  source 1..632: mol_type = other DNA

SEQ ID NO: 14532 - DNA, 1320 bp, synthetic construct; identical to SEQ ID NO: 8817
  misc_feature 1..1320: note = Synthetic polypeptide
  source 1..1320: mol_type = other DNA

SEQ ID NO: 14533 - DNA, 420 bp, synthetic construct; identical to SEQ ID NO: 8818
  misc_feature 1..420: note = Synthetic polypeptide
  source 1..420: mol_type = other DNA

SEQ ID NO: 14534 - DNA, 355 bp, synthetic construct; identical to SEQ ID NO: 8039
  misc_feature 1..355: note = Synthetic polypeptide
  source 1..355: mol_type = other DNA

SEQ ID NO: 14535 - DNA, 1133 bp, synthetic construct; identical to SEQ ID NO: 7332
  misc_feature 1..1133: note = Synthetic polypeptide
  source 1..1133: mol_type = other DNA

SEQ ID NO: 14536 - DNA, 1172 bp, synthetic construct; identical to SEQ ID NO: 7333
  misc_feature 1..1172: note = Synthetic polypeptide
  source 1..1172: mol_type = other DNA

SEQ ID NO: 14537 - DNA, 434 bp, synthetic construct; identical to SEQ ID NO: 8041
  misc_feature 1..434: note = Synthetic polypeptide
  source 1..434: mol_type = other DNA

SEQ ID NO: 14538 - DNA, 526 bp, synthetic construct; identical to SEQ ID NO: 10237
  misc_feature 1..526: note = Synthetic polypeptide
  source 1..526: mol_type = other DNA

SEQ ID NO: 14539 - DNA, 1314 bp, synthetic construct; identical to SEQ ID NO: 10238
  misc_feature 1..1314: note = Synthetic polypeptide
  source 1..1314: mol_type = other DNA

SEQ ID NO: 14540 - DNA, 1218 bp, synthetic construct; identical to SEQ ID NO: 10239
  misc_feature 1..1218: note = Synthetic polypeptide
  source 1..1218: mol_type = other DNA

SEQ ID NO: 14541 - DNA, 1197 bp, synthetic construct; identical to SEQ ID NO: 10240
  misc_feature 1..1197: note = Synthetic polypeptide
  source 1..1197: mol_type = other DNA

SEQ ID NO: 14542 - DNA, 919 bp, synthetic construct; identical to SEQ ID NO: 10241
  misc_feature 1..919: note = Synthetic polypeptide
  source 1..919: mol_type = other DNA

SEQ ID NO: 14543 - DNA, 629 bp, synthetic construct; identical to SEQ ID NO: 10242
  misc_feature 1..629: note = Synthetic polypeptide
  source 1..629: mol_type = other DNA

SEQ ID NO: 14544 - DNA, 80 bp, synthetic construct; identical to SEQ ID NO: 6364
  misc_feature 1..80: note = Synthetic polypeptide
  source 1..80: mol_type = other DNA

SEQ ID NO: 14545 - DNA, 217 bp, synthetic construct; identical to SEQ ID NO: 6365
  misc_feature 1..217: note = Synthetic polypeptide
  source 1..217: mol_type = other DNA

SEQ ID NO: 14546 - DNA, 560 bp, synthetic construct; identical to SEQ ID NO: 6322
  misc_feature 1..560: note = Synthetic polypeptide
  source 1..560: mol_type = other DNA

SEQ ID NO: 14547 - DNA, 2200 bp, synthetic construct
  misc_feature 1..2200: note = Synthetic polypeptide
  source 1..2200: mol_type = other DNA
ggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctga

SEQ ID NO: 14548 - DNA, 2173 bp, synthetic construct
  misc_feature 1..2173: note = Synthetic polypeptide
  source 1..2173: mol_type = other DNA
ggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctga

SEQ ID NO: 14549 - DNA, 1409 bp, synthetic construct
  misc_feature 1..1409: note = Synthetic polypeptide
  source 1..1409: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14550 - DNA, 1463 bp, synthetic construct
  misc_feature 1..1463: note = Synthetic polypeptide
  source 1..1463: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14551 - DNA, 1667 bp, synthetic construct
  misc_feature 1..1667: note = Synthetic polypeptide
  source 1..1667: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggtgctgcaggagcaggagtgctgggtgggctagtgccaggtgccccaggcgcagtcccaggtgtgccgggcacgggaggagtgccaggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14552 - DNA, 1328 bp, synthetic construct
  misc_feature 1..1328: note = Synthetic polypeptide
  source 1..1328: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14553 - DNA, 1406 bp, synthetic construct
  misc_feature 1..1406: note = Synthetic polypeptide
  source 1..1406: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14554 - DNA, 1481 bp, synthetic construct
  misc_feature 1..1481: note = Synthetic polypeptide
  source 1..1481: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14555 - DNA, 1352 bp, synthetic construct
  misc_feature 1..1352: note = Synthetic polypeptide
  source 1..1352: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14556 - DNA, 1307 bp, synthetic construct
  misc_feature 1..1307: note = Synthetic polypeptide
  source 1..1307: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14557 - DNA, 1562 bp, synthetic construct
  misc_feature 1..1562: note = Synthetic polypeptide
  source 1..1562: mol_type = other DNA
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14558 - DNA, 1045 bp, synthetic construct; identical to SEQ ID NO: 8898
  misc_feature 1..1045: note = Synthetic polypeptide
  source 1..1045: mol_type = other DNA

SEQ ID NO: 14559 - DNA, 1861 bp, synthetic construct; identical to SEQ ID NO: 6680
  misc_feature 1..1861: note = Synthetic polypeptide
  source 1..1861: mol_type = other DNA

SEQ ID NO: 14560 - DNA, 1123 bp, synthetic construct; identical to SEQ ID NO: 6681
  misc_feature 1..1123: note = Synthetic polypeptide
  source 1..1123: mol_type = other DNA

SEQ ID NO: 14561 - DNA, 540 bp, synthetic construct; identical to SEQ ID NO: 6590
  misc_feature 1..540: note = Synthetic polypeptide
  source 1..540: mol_type = other DNA

SEQ ID NO: 14562 - DNA, 163 bp, synthetic construct; identical to SEQ ID NO: 480
  misc_feature 1..163: note = Synthetic polypeptide
  source 1..163: mol_type = other DNA

SEQ ID NO: 14563 - DNA, 104 bp, synthetic construct; identical to SEQ ID NO: 481
  misc_feature 1..104: note = Synthetic polypeptide
  source 1..104: mol_type = other DNA

SEQ ID NO: 14564 - DNA, 309 bp, synthetic construct; identical to SEQ ID NO: 7876
  misc_feature 1..309: note = Synthetic polypeptide
  source 1..309: mol_type = other DNA

SEQ ID NO: 14565 - DNA, 588 bp, synthetic construct; identical to SEQ ID NO: 6349
  misc_feature 1..588: note = Synthetic polypeptide
  source 1..588: mol_type = other DNA

SEQ ID NO: 14566 - DNA, 1376 bp, synthetic construct; identical to SEQ ID NO: 6350
  misc_feature 1..1376: note = Synthetic polypeptide
  source 1..1376: mol_type = other DNA

SEQ ID NO: 14567 - DNA, 1280 bp, synthetic construct; identical to SEQ ID NO: 6351
  misc_feature 1..1280: note = Synthetic polypeptide
  source 1..1280: mol_type = other DNA

SEQ ID NO: 14568 - DNA, 1259 bp, synthetic construct; identical to SEQ ID NO: 6352
  misc_feature 1..1259: note = Synthetic polypeptide
  source 1..1259: mol_type = other DNA

SEQ ID NO: 14569 - DNA, 981 bp, synthetic construct; identical to SEQ ID NO: 6353
  misc_feature 1..981: note = Synthetic polypeptide
  source 1..981: mol_type = other DNA

SEQ ID NO: 14570 - DNA, 691 bp, synthetic construct; identical to SEQ ID NO: 6354
  misc_feature 1..691: note = Synthetic polypeptide
  source 1..691: mol_type = other DNA

SEQ ID NO: 14571 - DNA, 841 bp, synthetic construct
  misc_feature 1..841: note = Synthetic polypeptide
  source 1..841: mol_type = other DNA
ggctgggcgtggtggctcatgcctgtaatcccagcactttgggaggctgaggtgggtggatcacctgaggtcaggagttcgagaccagcctggccaacatggtgaaaccccatctctactaaaaaaaaaaaaaaaacattagctgggcacctgtaatctcagctacttgtgaggctgaggcaggaaaatcacttgaacctgggaggtagagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 14572 - DNA, 161 bp, synthetic construct; identical to SEQ ID NO: 7668
  misc_feature 1..161: note = Synthetic polypeptide
  source 1..161: mol_type = other DNA

SEQ ID NO: 14573 - DNA, 178 bp, synthetic construct; identical to SEQ ID NO: 7669
  misc_feature 1..178: note = Synthetic polypeptide
  source 1..178: mol_type = other DNA

SEQ ID NO: 14574 - DNA, 763 bp, synthetic construct; identical to SEQ ID NO: 606
  misc_feature 1..763: note = Synthetic polypeptide
  source 1..763: mol_type = other DNA

SEQ ID NO: 14575 - DNA, 952 bp, synthetic construct; identical to SEQ ID NO: 8583
  misc_feature 1..952: note = Synthetic polypeptide
  source 1..952: mol_type = other DNA

SEQ ID NO: 14576 - DNA, 87 bp, synthetic construct; identical to SEQ ID NO: 8584
  misc_feature 1..87: note = Synthetic polypeptide
  source 1..87: mol_type = other DNA

SEQ ID NO: 14577 - DNA, 1084 bp, synthetic construct; identical to SEQ ID NO: 580
  misc_feature 1..1084: note = Synthetic polypeptide
  source 1..1084: mol_type = other DNA

SEQ ID NO: 14578 - DNA, 871 bp, synthetic construct; identical to SEQ ID NO: 437
  misc_feature 1..871: note = Synthetic polypeptide
  source 1..871: mol_type = other DNA

SEQ ID NO: 14579 - DNA, 421 bp, synthetic construct; identical to SEQ ID NO: 441
  misc_feature 1..421: note = Synthetic polypeptide
  source 1..421: mol_type = other DNA

SEQ ID NO: 14580 - DNA, 638 bp, synthetic construct; identical to SEQ ID NO: 442
  misc_feature 1..638: note = Synthetic polypeptide
  source 1..638: mol_type = other DNA

SEQ ID NO: 14581 - DNA, 337 bp, synthetic construct; identical to SEQ ID NO: 443
  misc_feature 1..337: note = Synthetic polypeptide
  source 1..337: mol_type = other DNA

SEQ ID NO: 14582 - DNA, 337 bp, synthetic construct; identical to SEQ ID NO: 6393
  misc_feature 1..337: note = Synthetic polypeptide
  source 1..337: mol_type = other DNA

SEQ ID NO: 14583 - DNA, 1344 bp, synthetic construct
  misc_feature 1..1344: note = Synthetic polypeptide
  source 1..1344: mol_type = other DNA
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctag

SEQ ID NO: 14584 - DNA, 454 bp, synthetic construct
  misc_feature 1..454: note = Synthetic polypeptide
  source 1..454: mol_type = other DNA
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagc

SEQ ID NO: 14585 - DNA, 453 bp, synthetic construct
  misc_feature 1..453: note = Synthetic polypeptide
  source 1..453: mol_type = other DNA
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaag

SEQ ID NO: 14586 - DNA, 402 bp, synthetic construct
  misc_feature 1..402: note = Synthetic polypeptide
  source 1..402: mol_type = other DNA
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaag

SEQ ID NO: 14587 - DNA, 700 bp, synthetic construct
  misc_feature 1..700: note = Synthetic polypeptide
  source 1..700: mol_type = other DNA
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataa

SEQ ID NO: 14588 - DNA, 233 bp, synthetic construct
  misc_feature 1..233: note = Synthetic polypeptide
  source 1..233: mol_type = other DNA
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactag

SEQ ID NO: 14589 - DNA, 739 bp, synthetic construct
  misc_feature 1..739: note = Synthetic polypeptide
  source 1..739: mol_type = other DNA
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattgggctggaggacaatggcgcactgcaacctccacctcccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataa

SEQ ID NO: 14590 - DNA, 342 bp, synthetic construct; identical to SEQ ID NO: 7076
  misc_feature 1..342: note = Synthetic polypeptide
  source 1..342: mol_type = other DNA

SEQ ID NO: 14591 - DNA, 1516 bp, synthetic construct; identical to SEQ ID NO: 7077
  misc_feature 1..1516: note = Synthetic polypeptide
  source 1..1516: mol_type = other DNA

SEQ ID NO: 14592 - DNA, 1444 bp, synthetic construct; identical to SEQ ID NO: 7078
  misc_feature 1..1444: note = Synthetic polypeptide
  source 1..1444: mol_type = other DNA

SEQ ID NO: 14593 - DNA, 1312 bp, synthetic construct; identical to SEQ ID NO: 7079
  misc_feature 1..1312: note = Synthetic polypeptide
  source 1..1312: mol_type = other DNA

SEQ ID NO: 14594 - DNA, 74 bp, synthetic construct; identical to SEQ ID NO: 7010
  misc_feature 1..74: note = Synthetic polypeptide
  source 1..74: mol_type = other DNA

SEQ ID NO: 14595 - DNA, 471 bp, synthetic construct; identical to SEQ ID NO: 10499
  misc_feature 1..471: note = Synthetic polypeptide
  source 1..471: mol_type = other DNA

SEQ ID NO: 14596 - DNA, 395 bp, synthetic construct; identical to SEQ ID NO: 10500
  misc_feature 1..395: note = Synthetic polypeptide
  source 1..395: mol_type = other DNA

SEQ ID NO: 14597 - DNA, 130 bp, synthetic construct
  misc_feature 1..130: note = Synthetic polypeptide
  source 1..130: mol_type = other DNA
ttggcaaagcaactactagaactgagaagggaatatagcaaggctggctgaaggcggtgcaggtcctcatggtgctctccctcattctctgctgtctctccttcatcctgttcatgttccagctctacac

SEQ ID NO: 14598 - DNA, 353 bp, synthetic construct
  misc_feature 1..353: note = Synthetic polypeptide
  source 1..353: mol_type = other DNA
ttggcaaagcaactactagaactgagaagggaatatagcaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtga

SEQ ID NO: 14599 - DNA, 407 bp, synthetic construct
  misc_feature 1..407: note = Synthetic polypeptide
  source 1..407: mol_type = other DNA
ttggcaaagcaactactagaactgagaagggaatatagcaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcg

SEQ ID NO: 14600 - DNA, 2157 bp, synthetic construct; identical to SEQ ID NO: 6426
  misc_feature 1..2157: note = Synthetic polypeptide
  source 1..2157: mol_type = other DNA

SEQ ID NO: 14601 - DNA, 799 bp, synthetic construct; identical to SEQ ID NO: 6427
  misc_feature 1..799: note = Synthetic polypeptide
  source 1..799: mol_type = other DNA

SEQ ID NO: 14602 - DNA, 336 bp, synthetic construct; identical to SEQ ID NO: 6428
  misc_feature 1..336: note = Synthetic polypeptide
  source 1..336: mol_type = other DNA

SEQ ID NO: 14603 - DNA, 3477 bp, synthetic construct
  misc_feature 1..3477: note = Synthetic polypeptide
  source 1..3477: mol_type = other DNA
ggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctag

SEQ ID NO: 14604 - DNA, 1221 bp, synthetic construct
  misc_feature 1..1221: note = Synthetic polypeptide
  source 1..1221: mol_type = other DNA
ggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctag

SEQ ID NO: 14605 - DNA, 708 bp, synthetic construct
  misc_feature 1..708: note = Synthetic polypeptide
  source 1..708: mol_type = other DNA
tgtacagaaaagagttaacataacaagcctgagaccgctcttcttaaaaaggcttgctggcaaggctgggccttggctggcttctgggaacttggattttgtgggtatttgtactactctaactgataagagtggttcactgtgcctaaactgtttgtgtaaacattgtggtttaggctgaacatctgctttccttctgagagtctggaatcttggtacgtgctaggcagagggtgcctaagtgaccagcccccagtagagaactttcacagtgagtgtctaatgagtttccctggtagaaaacacttcacacatgtcataattccatgctggaagaattaagtgcatcctgtgactctaccgggaggactcttgaaaatcagcacctgatttcctctggacttttccctttgatgatttttctttgtatccttttgctgtaataaatcatagccatgggtatgactatacgctgagtcctgctaatgaatcactgaacctggaaggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctag

SEQ ID NO: 14606 - DNA, 2578 bp, synthetic construct; identical to SEQ ID NO: 7194
  misc_feature 1..2578: note = Synthetic polypeptide
  source 1..2578: mol_type = other DNA

SEQ ID NO: 14607 - DNA, 2305 bp, synthetic construct; identical to SEQ ID NO: 7195
  misc_feature 1..2305: note = Synthetic polypeptide
  source 1..2305: mol_type = other DNA

SEQ ID NO: 14608 - DNA, 1759 bp, synthetic construct; identical to SEQ ID NO: 7196
  misc_feature 1..1759: note = Synthetic polypeptide
  source 1..1759: mol_type = other DNA

SEQ ID NO: 14609 - DNA, 1880 bp, synthetic construct
  misc_feature 1..1880: note = Synthetic polypeptide
  source 1..1880: mol_type = other DNA
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctga

SEQ ID NO: 14610 - DNA, 1807 bp, synthetic construct
  misc_feature 1..1807: note = Synthetic polypeptide
  source 1..1807: mol_type = other DNA
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacac

SEQ ID NO: 14611 - DNA, 1094 bp, synthetic construct
  misc_feature 1..1094: note = Synthetic polypeptide
  source 1..1094: mol_type = other DNA
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggaacaacctgccacactttcagctgcccatggcatttatgggcacaagtcatgttccagcacatccctggacccatgggcttctcagagtggttacctcgaaacagctaa

SEQ ID NO: 14612 - DNA, 520 bp, synthetic construct
  misc_feature 1..520: note = Synthetic polypeptide
  source 1..520: mol_type = other DNA
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgacttt

SEQ ID NO: 14613 - DNA, 216 bp, synthetic construct
  misc_feature 1..216: note = Synthetic polypeptide
  source 1..216: mol_type = other DNA
agccagatttcagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctag

SEQ ID NO: 14614 - DNA, 367 bp, synthetic construct; identical to SEQ ID NO: 548
  misc_feature 1..367: note = Synthetic polypeptide
  source 1..367: mol_type = other DNA

SEQ ID NO: 14615 - DNA, 1017 bp, synthetic construct
  misc_feature 1..1017: note = Synthetic polypeptide
  source 1..1017: mol_type = other DNA
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatga

SEQ ID NO: 14616 - DNA, 579 bp, synthetic construct
  misc_feature 1..579: note = Synthetic polypeptide
  source 1..579: mol_type = other DNA
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtgctgtga

SEQ ID NO: 14617 - DNA, 486 bp, synthetic construct
  misc_feature 1..486: note = Synthetic polypeptide
  source 1..486: mol_type = other DNA
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagtatatctcagagatgttgcaggtcttgttccagaccaccacaataa

SEQ ID NO: 14618 - DNA, 613 bp, synthetic construct
  misc_feature 1..613: note = Synthetic polypeptide
  source 1..613: mol_type = other DNA
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccac

SEQ ID NO: 14619 - DNA, 435 bp, synthetic construct; identical to SEQ ID NO: 11492
  misc_feature 1..435: note = Synthetic polypeptide
  source 1..435: mol_type = other DNA

SEQ ID NO: 14620 - DNA, 351 bp, synthetic construct; identical to SEQ ID NO: 11493
  misc_feature 1..351: note = Synthetic polypeptide
  source 1..351: mol_type = other DNA

SEQ ID NO: 14621 - DNA, 947 bp, synthetic construct; identical to SEQ ID NO: 6434
  misc_feature 1..947: note = Synthetic polypeptide
  source 1..947: mol_type = other DNA

SEQ ID NO: 14622 - DNA, 881 bp, synthetic construct; identical to SEQ ID NO: 6435
  misc_feature 1..881: note = Synthetic polypeptide
  source 1..881: mol_type = other DNA

SEQ ID NO: 14623 - DNA, 1170 bp, synthetic construct
  misc_feature 1..1170: note = Synthetic polypeptide
  source 1..1170: mol_type = other DNA
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaa

SEQ ID NO: 14624 - DNA, 1104 bp, synthetic construct
  misc_feature 1..1104: note = Synthetic polypeptide
  source 1..1104: mol_type = other DNA
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataa

SEQ ID NO: 14625 - DNA, 303 bp, synthetic construct
  misc_feature 1..303: note = Synthetic polypeptide
  source 1..303: mol_type = other DNA
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacaatgaggcaagtgagcaatcggatgaagaggacagtgtgcagtcgctccatggggtga

SEQ ID NO: 14626 - DNA, 739 bp, synthetic construct
  misc_feature 1..739: note = Synthetic polypeptide
  source 1..739: mol_type = other DNA
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaag

SEQ ID NO: 14627 - DNA, 500 bp, synthetic construct
  misc_feature 1..500: note = Synthetic polypeptide
  source 1..500: mol_type = other DNA
agtagtcctcccttatctgtggtttcagttacccatggttcagtgaggtccaacaatattcagtgaaaaattccataaataaacaactgatacgttttgaattgcatgccgttcttagtagtgtgatgaaatctcgcgccacccagctccatcctgcccgggatgtgaatcatccttttgtccatcgtattcctgctgtagacatgactcaacccacccatcacttagcagccgtctgggttatcagattgactgtcatagcggcacagtgcttgtgttcaagcaacccttattttacttcccgatggccccaaagtgcaagagtagcgacgctggtgattccgacatgccagaaagaggctgcaaagtgcttcctgtaagcgaaaagctgaaagttctcaatgtaataaggaaagaaaaagaaatcatatgctgaggttgctaagatctatggtactcagggagttttgagattttccaagatgccatcgaggaactga

SEQ ID NO: 14628 - DNA, 956 bp, synthetic construct
  misc_feature 1..956: note = Synthetic polypeptide
  source 1..956: mol_type = other DNA
gtggtaccaggaaggcagcagcttggtgtcatgggacaagccacgccaaggccaaagctgaggcagcggaacaggccgccctggctgccaaccaggagtccaacattgctcgcactttggccagggagctggctccggacttctaccagccaggtccggaatatcagaagcgccggctgctgcaggagatcctggagaactcggagagcctgctggagccccccgaccggggcgccggcgcagcgggcctcccacagccgccccgcgagagcccgcagctgcacgagcgtgagacccctcggcccgagggtggctccccgtcaccggccgggacgcccccgcagcccaagcggcccaggcccggggtgtccaaggacggcctgctgagcccaggcgcctggaacggcgagcccagcggtgagggcagccggtcagtcactccgtccgagggcgcgggccgccgcagccccgcgcgtccagccaccgagcgcatggccatcgaggctctgcaggcaccgcctgcgccgtcgcgggagccggaggtggcgctttaccagggctaccacagctatgctgtgcgcaccacgccgcccgagcccccaccctttgaggaccagcccgagcccgaggtctccgggtccgagtccgcgccctcgtccccggccaccgccccgctgcaggcccccacgctccgaggccccgagcctgcacgcgagacccccgccaagctggagcccaagcccatcatccccaaagccgagcccagggccaaggcccgcaagactgaggctcgagggctgaccaaggcgggggccaagaagaaggcgcggaaggaggccgcactggcggcagaggcggaggtggaggtggaagaggtccccaacaccatcctcatctgcatggtgatcctgctgaacatcggcctggccatcctctttgttcacctcctgacctga

SEQ ID NO: 14629 - DNA, 662 bp, synthetic construct; identical to SEQ ID NO: 10265
  misc_feature 1..662: note = Synthetic polypeptide
  source 1..662: mol_type = other DNA

SEQ ID NO: 14630 - DNA, 1516 bp, synthetic construct; identical to SEQ ID NO: 534
  misc_feature 1..1516: note = Synthetic polypeptide
  source 1..1516: mol_type = other DNA

SEQ ID NO: 14631 - DNA, 591 bp, synthetic construct; identical to SEQ ID NO: 539
  misc_feature 1..591: note = Synthetic polypeptide
  source 1..591: mol_type = other DNA

SEQ ID NO: 14632 - DNA, 482 bp, synthetic construct; identical to SEQ ID NO: 540
  misc_feature 1..482: note = Synthetic polypeptide
  source 1..482: mol_type = other DNA

SEQ ID NO: 14633 - DNA, 444 bp, synthetic construct; identical to SEQ ID NO: 541
  misc_feature 1..444: note = Synthetic polypeptide
  source 1..444: mol_type = other DNA

SEQ ID NO: 14634 - DNA, 334 bp, synthetic construct; identical to SEQ ID NO: 533
  misc_feature 1..334: note = Synthetic polypeptide
  source 1..334: mol_type = other DNA

SEQ ID NO: 14635 - DNA, 38 bp, synthetic construct; identical to SEQ ID NO: 543
  misc_feature 1..38: note = Synthetic polypeptide
  source 1..38: mol_type = other DNA

SEQ ID NO: 14636 - DNA, 245 bp, synthetic construct; identical to SEQ ID NO: 542
  misc_feature 1..245: note = Synthetic polypeptide
  source 1..245: mol_type = other DNA

SEQ ID NO: 14637 - DNA, 517 bp, synthetic construct; identical to SEQ ID NO: 7016
  misc_feature 1..517: note = Synthetic polypeptide
  source 1..517: mol_type = other DNA

SEQ ID NO: 14638 - DNA, 1114 bp, synthetic construct; identical to SEQ ID NO: 9614
  misc_feature 1..1114: note = Synthetic polypeptide
  source 1..1114: mol_type = other DNA

SEQ ID NO: 14639 - DNA, 971 bp, synthetic construct
  misc_feature 1..971: note = Synthetic polypeptide
  source 1..971: mol_type = other DNA
tgcctgcctggcggttctgaagatcaaatgaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtag

SEQ ID NO: 14640 - DNA, 410 bp, synthetic construct
  misc_feature 1..410: note = Synthetic polypeptide
  source 1..410: mol_type = other DNA
tgcctgcctggcggttctgaagatcaaatgaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcag

SEQ ID NO: 14641 - DNA, 1901 bp, synthetic construct; identical to SEQ ID NO: 7113
  misc_feature 1..1901: note = Synthetic polypeptide
  source 1..1901: mol_type = other DNA

SEQ ID NO: 14642 - DNA, 1739 bp, synthetic construct; identical to SEQ ID NO: 7114
  misc_feature 1..1739: note = Synthetic polypeptide
  source 1..1739: mol_type = other DNA

SEQ ID NO: 14643 - DNA, 1859 bp, synthetic construct; identical to SEQ ID NO: 7115
  misc_feature 1..1859: note = Synthetic polypeptide
  source 1..1859: mol_type = other DNA

SEQ ID NO: 14644 - DNA, 1616 bp, synthetic construct; identical to SEQ ID NO: 7116
  misc_feature 1..1616: note = Synthetic polypeptide
  source 1..1616: mol_type = other DNA

SEQ ID NO: 14645 - DNA, 501 bp, synthetic construct; identical to SEQ ID NO: 7117
  misc_feature 1..501: note = Synthetic polypeptide
  source 1..501: mol_type = other DNA

SEQ ID NO: 14646 - DNA, 369 bp, synthetic construct; identical to SEQ ID NO: 7118
  misc_feature 1..369: note = Synthetic polypeptide
  source 1..369: mol_type = other DNA

SEQ ID NO: 14647 - DNA, 1731 bp, synthetic construct; identical to SEQ ID NO: 6691
  misc_feature 1..1731: note = Synthetic polypeptide
  source 1..1731: mol_type = other DNA

SEQ ID NO: 14648 - DNA, 2019 bp, synthetic construct; identical to SEQ ID NO: 6692
  misc_feature 1..2019: note = Synthetic polypeptide
  source 1..2019: mol_type = other DNA

SEQ ID NO: 14649 - DNA, 2043 bp, synthetic construct; identical to SEQ ID NO: 6693
  misc_feature 1..2043: note = Synthetic polypeptide
  source 1..2043: mol_type = other DNA

SEQ ID NO: 14650 - DNA, 554 bp, synthetic construct; identical to SEQ ID NO: 6694
  misc_feature 1..554: note = Synthetic polypeptide
  source 1..554: mol_type = other DNA

SEQ ID NO: 14651 - DNA, 853 bp, synthetic construct; identical to SEQ ID NO: 9052
  misc_feature 1..853: note = Synthetic polypeptide
  source 1..853: mol_type = other DNA

SEQ ID NO: 14652 - DNA, 265 bp, synthetic construct; identical to SEQ ID NO: 9053
  misc_feature 1..265: note = Synthetic polypeptide
  source 1..265: mol_type = other DNA

SEQ ID NO: 14653 - DNA, 4410 bp, synthetic construct
  misc_feature 1..4410: note = Synthetic polypeptide
  source 1..4410: mol_type = other DNA
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14654 - DNA, 4155 bp, synthetic construct
  misc_feature 1..4155: note = Synthetic polypeptide
  source 1..4155: mol_type = other DNA
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14655 - DNA, 324 bp, synthetic construct
  misc_feature 1..324: note = Synthetic polypeptide
  source 1..324: mol_type = other DNA
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaa

SEQ ID NO: 14656 - DNA, 842 bp, synthetic construct; identical to SEQ ID NO: 6534
  misc_feature 1..842: note = Synthetic polypeptide
  source 1..842: mol_type = other DNA

SEQ ID NO: 14657 - DNA, 493 bp, synthetic construct; identical to SEQ ID NO: 12530
  misc_feature 1..493: note = Synthetic polypeptide
  source 1..493: mol_type = other DNA

SEQ ID NO: 14658 - DNA, 970 bp, synthetic construct; identical to SEQ ID NO: 711
  misc_feature 1..970: note = Synthetic polypeptide
  source 1..970: mol_type = other DNA

SEQ ID NO: 14659 - DNA, 423 bp, synthetic construct; identical to SEQ ID NO: 6550
  misc_feature 1..423: note = Synthetic polypeptide
  source 1..423: mol_type = other DNA

SEQ ID NO: 14660 - DNA, 456 bp, synthetic construct; identical to SEQ ID NO: 6649
  misc_feature 1..456: note = Synthetic polypeptide
  source 1..456: mol_type = other DNA

SEQ ID NO: 14661 - DNA, 480 bp, synthetic construct; identical to SEQ ID NO: 6650
  misc_feature 1..480: note = Synthetic polypeptide
  source 1..480: mol_type = other DNA

SEQ ID NO: 14662 - DNA, 186 bp, synthetic construct; identical to SEQ ID NO: 6651
  misc_feature 1..186: note = Synthetic polypeptide
  source 1..186: mol_type = other DNA

SEQ ID NO: 14663 - DNA, 1025 bp, synthetic construct; identical to SEQ ID NO: 6438
  misc_feature 1..1025: note = Synthetic polypeptide
  source 1..1025: mol_type = other DNA

SEQ ID NO: 14664 - DNA, 857 bp, synthetic construct; identical to SEQ ID NO: 6439
  misc_feature 1..857: note = Synthetic polypeptide
  source 1..857: mol_type = other DNA

SEQ ID NO: 14665 - DNA, 581 bp, synthetic construct; identical to SEQ ID NO: 6440
  misc_feature 1..581: note = Synthetic polypeptide
  source 1..581: mol_type = other DNA

SEQ ID NO: 14666 - DNA, 317 bp, synthetic construct; identical to SEQ ID NO: 6441
  misc_feature 1..317: note = Synthetic polypeptide
  source 1..317: mol_type = other DNA

SEQ ID NO: 14667 - DNA, 369 bp, synthetic construct; identical to SEQ ID NO: 6492
  misc_feature 1..369: note = Synthetic polypeptide
  source 1..369: mol_type = other DNA

SEQ ID NO: 14668 - DNA, 853 bp, synthetic construct; identical to SEQ ID NO: 10246
  misc_feature 1..853: note = Synthetic polypeptide
  source 1..853: mol_type = other DNA

SEQ ID NO: 14669 - DNA, 3222 bp, synthetic construct
  misc_feature 1..3222: note = Synthetic polypeptide
  source 1..3222: mol_type = other DNA
tgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 14670 - DNA, 1287 bp, synthetic construct
  misc_feature 1..1287: note = Synthetic polypeptide
  source 1..1287: mol_type = other DNA
tgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 14671 - DNA, 3545 bp, synthetic construct; identical to SEQ ID NO: 8594
  misc_feature 1..3545: note = Synthetic polypeptide
  source 1..3545: mol_type = other DNA

SEQ ID NO: 14672 - DNA, 3542 bp, synthetic construct; identical to SEQ ID NO: 8595
  misc_feature 1..3542: note = Synthetic polypeptide
  source 1..3542: mol_type = other DNA

SEQ ID NO: 14673 - DNA, 1628 bp, synthetic construct; identical to SEQ ID NO: 8596
  misc_feature 1..1628: note = Synthetic polypeptide
  source 1..1628: mol_type = other DNA

SEQ ID NO: 14674 - DNA, 557 bp, synthetic construct; identical to SEQ ID NO: 6591
  misc_feature 1..557: note = Synthetic polypeptide
  source 1..557: mol_type = other DNA

SEQ ID NO: 14675 - DNA, 372 bp, synthetic construct
  misc_feature 1..372: note = Synthetic polypeptide
  source 1..372: mol_type = other DNA
gatatggtttagatctgtgtttccacaaaattgcattacaaattataatccccagtgttggaggtggggcctggtgggaggtgactggatcatgggggtggtttctcatggatggtttagcaccatccccctagtgctgttcttgtgatagagttctcatgagatctgattgtttaaaagtgcgtgacatctccctgctctctctcttcctactgctcctggccatgtgaggtgctggctcacccttcaccttccatcagtattgtaagtttcctgagacctccccagaagctgagcagatgccagaatcatgcttcctgcaaagcctgcagaattcagggagataccagggttcgtcatgggcagcaatga

SEQ ID NO: 14676 - DNA, 677 bp, synthetic construct; identical to SEQ ID NO: 747
  misc_feature 1..677: note = Synthetic polypeptide
  source 1..677: mol_type = other DNA

SEQ ID NO: 14677 - DNA, 674 bp, synthetic construct; identical to SEQ ID NO: 748
  misc_feature 1..674: note = Synthetic polypeptide
  source 1..674: mol_type = other DNA

SEQ ID NO: 14678 - DNA, 395 bp, synthetic construct
  misc_feature 1..395: note = Synthetic polypeptide
  source 1..395: mol_type = other DNA
tgtgatagttaatactgagtggattgaaggatacaaagtactgatcttgggtgtgtctgtgagggtgttgccaaaagagattaacatttgagtcaggctagggaaggcagacccacccttgatctgggtgggcacaatctaatcagctgccagtgcagctagaatataagcaggaaaaaaaaatgtgaaaaagaaagactaacagcctcccagcctacatctttctcccatgctggttgcttgctgctcttgaacatcagactccaggttcttcagttttgggactcggactggctctccttgctcctgaacttgaagacagcctattgtgagactttgtgatcatgctggcactgatcccagtttatcctttgagattcagcagaagatcctga

SEQ ID NO: 14679 - DNA, 497 bp, synthetic construct
  misc_feature 1..497: note = Synthetic polypeptide
  source 1..497: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctga

SEQ ID NO: 14680 - DNA, 491 bp, synthetic construct
  misc_feature 1..491: note = Synthetic polypeptide
  source 1..491: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggtga

SEQ ID NO: 14681 - DNA, 929 bp, synthetic construct
  misc_feature 1..929: note = Synthetic polypeptide
  source 1..929: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 14682 - DNA, 545 bp, synthetic construct
  misc_feature 1..545: note = Synthetic polypeptide
  source 1..545: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcccagcaggagcttctgaacatgaagctatggaccatccacgagctgctgcaagatag

SEQ ID NO: 14683 - DNA, 437 bp, synthetic construct
  misc_feature 1..437: note = Synthetic polypeptide
  source 1..437: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcaggtgggtttagcagaagtctgtgctgggtcgggggagtttag

SEQ ID NO: 14684 - DNA, 848 bp, synthetic construct
  misc_feature 1..848: note = Synthetic polypeptide
  source 1..848: mol_type = other DNA
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 14685 - DNA, 2387 bp, synthetic construct; identical to SEQ ID NO: 7139
  misc_feature 1..2387: note = Synthetic polypeptide
  source 1..2387: mol_type = other DNA

SEQ ID NO: 14686 - DNA, 1478 bp, synthetic construct; identical to SEQ ID NO: 7140
  misc_feature 1..1478: note = Synthetic polypeptide
  source 1..1478: mol_type = other DNA

SEQ ID NO: 14687 - DNA, 567 bp, synthetic construct
  misc_feature 1..567: note = Synthetic polypeptide
  source 1..567: mol_type = other DNA
tatgatggttaatattgaatgtcatcttgattggattgaaggatgcaaagtattgtttctgggtgtgtctgtaagggtattgccaaaggagattaacatttgagtcagtggactgggaaaggcagatcaaccctcaatatgagtgggcaccatccaatcagctaccagcatgggtagaataaagcaggcagaagaggtggagagattagactggcttagcctcccagccaacatcttactcccgtgcttgatgtttcctgacctcgaacatcgaactccaggttcttaggctttgggactccgactggcttccttgttcctcagcttgcagatggactattgagggaccttgtgatcatggaaaaaaacaaaccaaccaacaaactgagcctgaaactgataacacagatacgtacagcatcatatttaagtaaccaatcggaattattgcagtggagatgttttattggtgggaaatacggtatcacaccatttcagacatcaggagataattatccctgtcttctcggaaccagcttcttcaaaggagtcaggaattatttatga

SEQ ID NO: 14688 - DNA, 1797 bp, synthetic construct; identical to SEQ ID NO: 7070
  misc_feature 1..1797: note = Synthetic polypeptide
  source 1..1797: mol_type = other DNA

SEQ ID NO: 14689 - DNA, 1081 bp, synthetic construct; identical to SEQ ID NO: 7071
  misc_feature 1..1081: note = Synthetic polypeptide
  source 1..1081: mol_type = other DNA

SEQ ID NO: 14690 - DNA, 1059 bp, synthetic construct; identical to SEQ ID NO: 7072
  misc_feature 1..1059: note = Synthetic polypeptide
  source 1..1059: mol_type = other DNA

SEQ ID NO: 14691 - DNA, 909 bp, synthetic construct; identical to SEQ ID NO: 7073
  misc_feature 1..909: note = Synthetic polypeptide
  source 1..909: mol_type = other DNA

SEQ ID NO: 14692 - DNA, 622 bp, synthetic construct
  misc_feature 1..622: note = Synthetic polypeptide
  source 1..622: mol_type = other DNA
gctgggcgcagtggctcacgtctgtaatcccagcagtttgggaggccaagacgagcagatcacctgaggtcaggagttcaagaccagtctggccaacatgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctga

SEQ ID NO: 14693 - DNA, 1388 bp, synthetic construct
  misc_feature 1..1388: note = Synthetic polypeptide
  source 1..1388: mol_type = other DNA
ggctgggcgcagtggctcacgcctgtaatcccagcactttgggaggccaaggcgggcagatcacctgaggtcgggagtttgagaccagcttgaccaacatggagaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactga

SEQ ID NO: 14694 - DNA, 677 bp, synthetic construct
  misc_feature 1..677: note = Synthetic polypeptide
  source 1..677: mol_type = other DNA
ggctgggcgcagtggctcacgcctgtaatcccagcactttgggaggccaaggcgggcagatcacctgaggtcgggagtttgagaccagcttgaccaacatggagaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtga

SEQ ID NO: 14695 - DNA, 1002 bp, synthetic construct; identical to SEQ ID NO: 13329
  misc_feature 1..1002: note = Synthetic polypeptide
  source 1..1002: mol_type = other DNA

SEQ ID NO: 14696 - DNA, 463 bp, synthetic construct; identical to SEQ ID NO: 11344
  misc_feature 1..463: note = Synthetic polypeptide
  source 1..463: mol_type = other DNA

SEQ ID NO: 14697 - DNA, 2000 bp, synthetic construct
  misc_feature 1..2000: note = Synthetic polypeptide
  source 1..2000: mol_type = other DNA
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttga

SEQ ID NO: 14698 - DNA, 391 bp, synthetic construct
  misc_feature 1..391: note = Synthetic polypeptide
  source 1..391: mol_type = other DNA
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctga

SEQ ID NO: 14699 - DNA, 576 bp, synthetic construct
  misc_feature 1..576: note = Synthetic polypeptide
  source 1..576: mol_type = other DNA
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctct

SEQ ID NO: 14700 - DNA, 670 bp, synthetic construct
  misc_feature 1..670: note = Synthetic polypeptide
  source 1..670: mol_type = other DNA
gcaaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactga

SEQ ID NO: 14701 - DNA, 53 bp, synthetic construct
  misc_feature 1..53: note = Synthetic polypeptide
  source 1..53: mol_type = other DNA
gcaaggaacccagctatttagtggtcgaagtgactttagaatcactaccttga

SEQ ID NO: 14702 - DNA, 331 bp, synthetic construct; identical to SEQ ID NO: 8434
  misc_feature 1..331: note = Synthetic polypeptide
  source 1..331: mol_type = other DNA

SEQ ID NO: 14703 - DNA, 1538 bp, synthetic construct; identical to SEQ ID NO: 8435
  misc_feature 1..1538: note = Synthetic polypeptide
  source 1..1538: mol_type = other DNA

SEQ ID NO: 14704 - DNA, 884 bp, synthetic construct; identical to SEQ ID NO: 8436
  misc_feature 1..884: note = Synthetic polypeptide
  source 1..884: mol_type = other DNA

SEQ ID NO: 14705 - DNA, 343 bp, synthetic construct; identical to SEQ ID NO: 8437
  misc_feature 1..343: note = Synthetic polypeptide
  source 1..343: mol_type = other DNA

SEQ ID NO: 14706 - DNA, 401 bp, synthetic construct; identical to SEQ ID NO: 8438
  misc_feature 1..401: note = Synthetic polypeptide
  source 1..401: mol_type = other DNA

SEQ ID NO: 14707 - DNA, 1535 bp, synthetic construct; identical to SEQ ID NO: 8439
  misc_feature 1..1535: note = Synthetic polypeptide
  source 1..1535: mol_type = other DNA

SEQ ID NO: 14708 - DNA, 255 bp, synthetic construct; identical to SEQ ID NO: 8440
  misc_feature 1..255: note = Synthetic polypeptide
  source 1..255: mol_type = other DNA

SEQ ID NO: 14709 - DNA, 88 bp, synthetic construct; identical to SEQ ID NO: 8441
  misc_feature 1..88: note = Synthetic polypeptide
  source 1..88: mol_type = other DNA

SEQ ID NO: 14710 - DNA, 429 bp, synthetic construct; identical to SEQ ID NO: 8442
  misc_feature 1..429: note = Synthetic polypeptide
  source 1..429: mol_type = other DNA

SEQ ID NO: 14711 - DNA, 996 bp, synthetic construct
  misc_feature 1..996: note = Synthetic polypeptide
  source 1..996: mol_type = other DNA
attttggccatatataaaaattctaaatcggtcagagacctaaatgtaaaacctagaactataaaaattttagaacaaaacataggagagaatctttgtgatcttggattaggcaaagatttcttaaatatgataccaaaaaaagaacaatccattaacaaattgataaattgggcttcatcaaaattaaaaactgctcttcccaagacaatattaggagacagaaaagacaaacaagagactgggaaaaaaaatctttgtaaagcatatgtttgataaaagatttgcatccaaaatatataaagtgttctaagctcaataatgaaacaactcaacattaaatgggcaaaagatctgaacggacacttcaccaaggaaaatacactcgctgcaaatacgcacatgaaaagatgcttaacatcattaacgattagagaatgcataataaagccacaatgagctaccactacacagaaccggaacatctacagttaaaatctctggactttcaagtgttggcaaggatgaagaacaactggaactcgcatagactgctagtgggaagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactga

SEQ ID NO: 14712 - DNA, 927 bp, synthetic construct
  misc_feature 1..927: note = Synthetic polypeptide
  source 1..927: mol_type = other DNA
attttggccatatataaaaattctaaatcggtcagagacctaaatgtaaaacctagaactataaaaattttagaacaaaacataggagagaatctttgtgatcttggattaggcaaagatttcttaaatatgataccaaaaaaagaacaatccattaacaaattgataaattgggcttcatcaaaattaaaaactgctcttcccaagacaatattaggagacagaaaagacaaacaagagactgggaaaaaaaatctttgtaaagcatatgtttgataaaagatttgcatccaaaatatataaagtgttctaagctcaataatgaaacaactcaacattaaatgggcaaaagatctgaacggacacttcaccaaggaaaatacactcgctgcaaatacgcacatgaaaagatgcttaacatcattaacgattagagaatgcataataaagccacaatgagctaccactacacagaaccggaacatctacagttaaaatctctggactttcaagtgttggcaaggatgaagaacaactggaactcgcatagactgctagtgggaagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagatccttgttggatatccagaaagaagtctttagcatcaaaggatcaagaagtccttccacttcgagaggcaatggcttcgatagtgaagttctgagaaaaagtactgctctggcactgggtggccttcgttttccgaggctcatggtacgtctggctctgatgaaagccacacagggatcctga

SEQ ID NO: 14713 - DNA, 618 bp, synthetic construct
  misc_feature 1..618: note = Synthetic polypeptide
  source 1..618: mol_type = other DNA
gctccttcagattcagagcccagtaccttggactcccagtcttcgaccaccttgttcctctcctcggaggagccaggcccctccaccgccgccctgccatctccctcctcctcttcctgcgagcctcaggccttttccccaggtccgccagcgctgcctccgctgttgcctccgctccccgcagcctcggcgcccccaggccccggcgcctcccggcgcacaggccgctactcagtcgtcgcctcctccccggaggccgccccgcgtctggtcgactggctccccggttgcccttcgaccatctctcccagcacacgcggggatgacaaggagcggccgccgcccgtcctggcaccggccgagggcccggaaaggagccgcgccccgcgccccagcactgcgggcagggaggagggcaccgtggacgcgggtacatccccgccgccccgagcccggcccgccgctgcggcgagcttggaggcccacgtcggggacatcctggtggagctgcggaccatgaacggccacctggacagcatagcgcgggccctcaccaaactggcttcgtccctggggccccagcctgagcccctgccagatgtttcggatgccaactaa

SEQ ID NO: 14714 - DNA, 2643 bp, synthetic construct
  misc_feature 1..2643: note = Synthetic polypeptide
  source 1..2643: mol_type = other DNA
tatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 14715 - DNA, 1734 bp, synthetic construct
  misc_feature 1..1734: note = Synthetic polypeptide
  source 1..1734: mol_type = other DNA
tatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 14716 - DNA, 2228 bp, synthetic construct
  misc_feature 1..2228: note = Synthetic polypeptide
  source 1..2228: mol_type = other DNA
ggccgggcatggtggctcatgcctataatgctagcactttgggaggccgaggcaggtggatcacctgaggtcaggagttcaagaccagcctggccaacatggcgaaaccccatctctactaaaaatacaaaattacccagacatggtggcacatgcctgtaatcccggctactcaggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaa

SEQ ID NO: 14717 - DNA, 1515 bp, synthetic construct
  misc_feature 1..1515: note = Synthetic polypeptide
  source 1..1515: mol_type = other DNA
tgcaatggactgaatgtttgtgtcccctccaaattcctatgttgaaatcctaatgcccaaagtgatgggactaggaggtggggcctctgggaggcgattaggtcatgggggtggagcccacgtgggtgggataagtgcccttataaaagggaccccagcggctccctcactctcttgctgccatgggagtataccgtgaggagtggggcggctgtgtagacacctgatctgccggtgccttggtcttggacttccagcctccagaacttgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactga

SEQ ID NO: 14718 - DNA, 1230 bp, synthetic construct
  misc_feature 1..1230: note = Synthetic polypeptide
  source 1..1230: mol_type = other DNA
tgcaatggactgaatgtttgtgtcccctccaaattcctatgttgaaatcctaatgcccaaagtgatgggactaggaggtggggcctctgggaggcgattaggtcatgggggtggagcccacgtgggtgggataagtgcccttataaaagggaccccagcggctccctcactctcttgctgccatgggagtataccgtgaggagtggggcggctgtgtagacacctgatctgccggtgccttggtcttggacttccagcctccagaacttgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctag

SEQ ID NO: 14719 - DNA, 2162 bp, synthetic construct
  misc_feature 1..2162: note = Synthetic polypeptide
  source 1..2162: mol_type = other DNA
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaacaaagcctcccaatcaccggcctgcagaaagctctgtgtccaccggctcctcgggcagcagctttggcagtgggtatagcgtggacagtgaaggaagcagcagcactgcaggggagactaatctatttcctattccgaggatagggaagatgggacagaatggacaagagcctgtaaaacagccaggggtaggagtaggactagcagacactgaagctaaaactcaggtaatgggagaaatcaagattgcattgaagaaggaaatgaagacagatggtgaacaactaatagttgaaattctccaatgcagaaatattacatacaaatttaagtctcctgatcatctaccagatttatatgtgaaaatatatgtgatgaatatttctacccaaaaaaaggtgatcaagaaaaaaacaagagtatgcagacatgatcgagagccttcgtttaatgaaacttttcgattcagtctaagtcctgcaggacattctcttcagattttacttttctccaatggagggaagtttatgaaaaagaccttgattggtgaagcctgtatctggcttgacaaagtggatctcagaaaaagaatagtcaactggcacaaacttttggtcagtcctactcaaacgcattga

SEQ ID NO: 14720 - DNA, 1541 bp, synthetic construct
  misc_feature 1..1541: note = Synthetic polypeptide
  source 1..1541: mol_type = other DNA
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataa

SEQ ID NO: 14721 - DNA, 401 bp, synthetic construct
  misc_feature 1..401: note = Synthetic polypeptide
  source 1..401: mol_type = other DNA
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagcctgggattgttga

SEQ ID NO: 14722 - DNA, 443 bp, synthetic construct
  misc_feature 1..443: note = Synthetic polypeptide
  source 1..443: mol_type = other DNA
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagatggcatggcagtgatcaaggttggagatcaagaaacacagcacacagatgagtga

SEQ ID NO: 14723 - DNA, 4487 bp, synthetic construct
  misc_feature 1..4487: note = Synthetic polypeptide
  source 1..4487: mol_type = other DNA
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14724 - DNA, 4232 bp, synthetic construct
  misc_feature 1..4232: note = Synthetic polypeptide
  source 1..4232: mol_type = other DNA
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14725 - DNA, 401 bp, synthetic construct
  misc_feature 1..401: note = Synthetic polypeptide
  source 1..401: mol_type = other DNA
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaa

SEQ ID NO: 14726 - DNA, 1556 bp, synthetic construct
  misc_feature 1..1556: note = Synthetic polypeptide
  source 1..1556: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatga

SEQ ID NO: 14727 - DNA, 1088 bp, synthetic construct
  misc_feature 1..1088: note = Synthetic polypeptide
  source 1..1088: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatga

SEQ ID NO: 14728 - DNA, 343 bp, synthetic construct
  misc_feature 1..343: note = Synthetic polypeptide
  source 1..343: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaat

SEQ ID NO: 14729 - DNA, 1520 bp, synthetic construct
  misc_feature 1..1520: note = Synthetic polypeptide
  source 1..1520: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatga

SEQ ID NO: 14730 - DNA, 1052 bp, synthetic construct
  misc_feature 1..1052: note = Synthetic polypeptide
  source 1..1052: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatga

SEQ ID NO: 14731 - DNA, 307 bp, synthetic construct
  misc_feature 1..307: note = Synthetic polypeptide
  source 1..307: mol_type = other DNA
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaat

SEQ ID NO: 14732 - DNA, 2729 bp, synthetic construct
  misc_feature 1..2729: note = Synthetic polypeptide
  source 1..2729: mol_type = other DNA
cctctttccggctgtgggactcaggcgagtcctttcagttgtctgagacgcagttcgtcatccggaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 14733 - DNA, 794 bp, synthetic construct
  misc_feature 1..794: note = Synthetic polypeptide
  source 1..794: mol_type = other DNA
cctctttccggctgtgggactcaggcgagtcctttcagttgtctgagacgcagttcgtcatccggaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 14734 - DNA, 1688 bp, synthetic construct
  misc_feature 1..1688: note = Synthetic polypeptide
  source 1..1688: mol_type = other DNA
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctga

SEQ ID NO: 14735 - DNA, 737 bp, synthetic construct
  misc_feature 1..737: note = Synthetic polypeptide
  source 1..737: mol_type = other DNA
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattga

SEQ ID NO: 14736 - DNA, 528 bp, synthetic construct
  misc_feature 1..528: note = Synthetic polypeptide
  source 1..528: mol_type = other DNA
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccag

SEQ ID NO: 14737 - DNA, 333 bp, synthetic construct; identical to SEQ ID NO: 6583
  misc_feature 1..333: note = Synthetic polypeptide
  source 1..333: mol_type = other DNA

SEQ ID NO: 14738 - DNA, 929 bp, synthetic construct
  misc_feature 1..929: note = Synthetic polypeptide
  source 1..929: mol_type = other DNA
tgtgatggttaattttatgtatcaatttgattgggctatgggatgcccagatagctggtaaagcattgctcctggatgtgtctgttggtgtgtttctggaagagattggcttttcaatgcagatcgctttttgccaatgcagaggggcagcatctagtccatcgagagcctgactagaacaaaagggtggaggaggggtgaattctctcttcttgagctggaacatgtgtcttcttctggcttcagacatcagagctcctggttcttgctccttgggactctgggacttacaccagtggcacccctggctccagccctttgaacctggactaagtcataccagcagctttcctggtcctccagcttgcaggtggcaaaacgtgggacttgctggcctttataatcatctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctga

SEQ ID NO: 14739 - DNA, 223 bp, synthetic construct; identical to SEQ ID NO: 10070
  misc_feature 1..223: note = Synthetic polypeptide
  source 1..223: mol_type = other DNA

SEQ ID NO: 14740 - DNA, 999 bp, synthetic construct
  misc_feature 1..999: note = Synthetic polypeptide
  source 1..999: mol_type = other DNA
cctgaccttcccgggcctcagtttccccactcataagatgagggctagggctccatctggaaggcggtgaggattagtggcttcacaggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataa

SEQ ID NO: 14741 - DNA, 966 bp, synthetic construct
  misc_feature 1..966: note = Synthetic polypeptide
  source 1..966: mol_type = other DNA
cctgaccttcccgggcctcagtttccccactcataagatgagggctagggctccatctggaaggcggtgaggattagtggcttcacaggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataa

SEQ ID NO: 14742 - DNA, 753 bp, synthetic construct; identical to SEQ ID NO: 7008
  misc_feature 1..753: note = Synthetic polypeptide
  source 1..753: mol_type = other DNA

SEQ ID NO: 14743 - DNA, 1482 bp, synthetic construct
  misc_feature 1..1482: note = Synthetic polypeptide
  source 1..1482: mol_type = other DNA
tgatatggtttggctgtgtccccatccaaatctcatcttgaattttaagccccataatccccatgtgtcatgggagggacccagtgtgaggcaatcggatcatgagggtggtttcccccatgctggtctcatgatagtgactgagttctcaggagatctgatggttttacaagcatctggcatttcccctgctggcactcattctctttcctgctgccctgtgaagaggtgccttttaccctgatcataagtttcctgaggcttccccagccatttggaactgagatcagtgcggttaattcttcaactatccaagcctcatattttggaacagacaagatcacccgtatcaacatagctggatggaaaacagatggcaaatggcagagagacatgtgcaatgtgttgctacagctggaagatataaattgcattaatttagattggatcaacggttcacgggaatacatccatgctgtaaacaatctccgtgttgttggtgctgaggtggcttattttattgatgttctcatgaaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcagttaggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaa

SEQ ID NO: 14744 - DNA, 1898 bp, synthetic construct
  misc_feature 1..1898: note = Synthetic polypeptide
  source 1..1898: mol_type = other DNA
tgatagggtttggctatgtcccacccaaatcttatcttgaattcccacgtgttgtgggagggacctggtgggaggcaactgaatcatggaagcaggtctttcccgtgctgttctcttgatagtaagtgtcacgggatctgatgattgtaagggggagattccctgcacaagctcactttgcctgctgccatccatgtaagatgtgacttgctgctccttgccttctgccatgattgtgaagcctccccacccatgtggaactgtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaa

SEQ ID NO: 14745 - DNA, 1739 bp, synthetic construct
  misc_feature 1..1739: note = Synthetic polypeptide
  source 1..1739: mol_type = other DNA
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14746 - DNA, 1694 bp, synthetic construct
  misc_feature 1..1694: note = Synthetic polypeptide
  source 1..1694: mol_type = other DNA
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14747 - DNA, 1616 bp, synthetic construct
  misc_feature 1..1616: note = Synthetic polypeptide
  source 1..1616: mol_type = other DNA
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14748 - DNA, 1628 bp, synthetic construct
  misc_feature 1..1628: note = Synthetic polypeptide
  source 1..1628: mol_type = other DNA
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14749 - DNA, 1631 bp, synthetic construct
  misc_feature 1..1631: note = Synthetic polypeptide
  source 1..1631: mol_type = other DNA
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctggactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14750 - DNA, 834 bp, synthetic construct; identical to SEQ ID NO: 7252
  misc_feature 1..834: note = Synthetic polypeptide
  source 1..834: mol_type = other DNA

SEQ ID NO: 14751 - DNA, 1691 bp, synthetic construct; identical to SEQ ID NO: 7480
  misc_feature 1..1691: note = Synthetic polypeptide
  source 1..1691: mol_type = other DNA

SEQ ID NO: 14752 - DNA, 1727 bp, synthetic construct; identical to SEQ ID NO: 7481
  misc_feature 1..1727: note = Synthetic polypeptide
  source 1..1727: mol_type = other DNA

SEQ ID NO: 14753 - DNA, 629 bp, synthetic construct; identical to SEQ ID NO: 7482
  misc_feature 1..629: note = Synthetic polypeptide
  source 1..629: mol_type = other DNA

SEQ ID NO: 14754 - DNA, 1553 bp, synthetic construct; identical to SEQ ID NO: 7483
  misc_feature 1..1553: note = Synthetic polypeptide
  source 1..1553: mol_type = other DNA

SEQ ID NO: 14755 - DNA, 1461 bp, synthetic construct
  misc_feature 1..1461: note = Synthetic polypeptide
  source 1..1461: mol_type = other DNA
atgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctag

SEQ ID NO: 14756 - DNA, 1196 bp, synthetic construct; identical to SEQ ID NO: 13863
  misc_feature 1..1196: note = Synthetic polypeptide
  source 1..1196: mol_type = other DNA

SEQ ID NO: 14757 - DNA, 1136 bp, synthetic construct; identical to SEQ ID NO: 13864
  misc_feature 1..1136: note = Synthetic polypeptide
  source 1..1136: mol_type = other DNA

SEQ ID NO: 14758 - DNA, 1118 bp, synthetic construct; identical to SEQ ID NO: 13865
  misc_feature 1..1118: note = Synthetic polypeptide
  source 1..1118: mol_type = other DNA

SEQ ID NO: 14759 - DNA, 1193 bp, synthetic construct; identical to SEQ ID NO: 13866
  misc_feature 1..1193: note = Synthetic polypeptide
  source 1..1193: mol_type = other DNA

SEQ ID NO: 14760 - DNA, 1155 bp, synthetic construct
  misc_feature 1..1155: note = Synthetic polypeptide
  source 1..1155: mol_type = other DNA
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactag

SEQ ID NO: 14761 - DNA, 957 bp, synthetic construct
  misc_feature 1..957: note = Synthetic polypeptide
  source 1..957: mol_type = other DNA
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactag

SEQ ID NO: 14762 - DNA, 1098 bp, synthetic construct
  misc_feature 1..1098: note = Synthetic polypeptide
  source 1..1098: mol_type = other DNA
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgcggggccaccagatcctgctgcctccaagctggggcctgagtag

SEQ ID NO: 14763 - DNA, 1093 bp, synthetic construct
  misc_feature 1..1093: note = Synthetic polypeptide
  source 1..1093: mol_type = other DNA
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagcacaggtacctgctgcatgccatgcctgagggcatcgaccagaacgaaccagacacgagtccctgccctctggaagctcacgttccagcagaggagaggacatggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaacc

SEQ ID NO: 14764 - DNA, 859 bp, synthetic construct; identical to SEQ ID NO: 6990
  misc_feature 1..859: note = Synthetic polypeptide
  source 1..859: mol_type = other DNA

SEQ ID NO: 14765 - DNA, 657 bp, synthetic construct; identical to SEQ ID NO: 6991
  misc_feature 1..657: note = Synthetic polypeptide
  source 1..657: mol_type = other DNA

SEQ ID NO: 14766 - DNA, 587 bp, synthetic construct; identical to SEQ ID NO: 6992
  misc_feature 1..587: note = Synthetic polypeptide
  source 1..587: mol_type = other DNA

SEQ ID NO: 14767 - DNA, 568 bp, synthetic construct; identical to SEQ ID NO: 6993
  misc_feature 1..568: note = Synthetic polypeptide
  source 1..568: mol_type = other DNA

SEQ ID NO: 14768 - DNA, 494 bp, synthetic construct; identical to SEQ ID NO: 6994
  misc_feature 1..494: note = Synthetic polypeptide
  source 1..494: mol_type = other DNA

SEQ ID NO: 14769 - DNA, 368 bp, synthetic construct; identical to SEQ ID NO: 6995
  misc_feature 1..368: note = Synthetic polypeptide
  source 1..368: mol_type = other DNA

SEQ ID NO: 14770 - DNA, 340 bp, synthetic construct; identical to SEQ ID NO: 8550
  misc_feature 1..340: note = Synthetic polypeptide
  source 1..340: mol_type = other DNA

SEQ ID NO: 14771 - DNA, 1008 bp, synthetic construct
  misc_feature 1..1008: note = Synthetic polypeptide
  source 1..1008: mol_type = other DNA
tgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctga

SEQ ID NO: 14772 - DNA, 1331 bp, synthetic construct; identical to SEQ ID NO: 550
  misc_feature 1..1331: note = Synthetic polypeptide
  source 1..1331: mol_type = other DNA

SEQ ID NO: 14773 - DNA, 1028 bp, synthetic construct; identical to SEQ ID NO: 551
  misc_feature 1..1028: note = Synthetic polypeptide
  source 1..1028: mol_type = other DNA

SEQ ID NO: 14774 - DNA, 1295 bp, synthetic construct; identical to SEQ ID NO: 553
  misc_feature 1..1295: note = Synthetic polypeptide
  source 1..1295: mol_type = other DNA

SEQ ID NO: 14775 - DNA, 1322 bp, synthetic construct; identical to SEQ ID NO: 554
  misc_feature 1..1322: note = Synthetic polypeptide
  source 1..1322: mol_type = other DNA

SEQ ID NO: 14776 - DNA, 1013 bp, synthetic construct; identical to SEQ ID NO: 555
  misc_feature 1..1013: note = Synthetic polypeptide
  source 1..1013: mol_type = other DNA

SEQ ID NO: 14777 - DNA, 2340 bp, synthetic construct
  misc_feature 1..2340: note = Synthetic polypeptide
  source 1..2340: mol_type = other DNA
aaaaagttaacgcatgcatagcgctgagcacggtgcctgtcacaaactacgctctgaagaaactcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtga

SEQ ID NO: 14778 - DNA, 383 bp, synthetic construct
  misc_feature 1..383: note = Synthetic polypeptide
  source 1..383: mol_type = other DNA
aaaaagttaacgcatgcatagcgctgagcacggtgcctgtcacaaactacgctctgaagaaactcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcct

SEQ ID NO: 14779 - DNA, 1516 bp, synthetic construct; identical to SEQ ID NO: 534
  misc_feature 1..1516: note = Synthetic polypeptide
  source 1..1516: mol_type = other DNA

SEQ ID NO: 14780 - DNA, 591 bp, synthetic construct; identical to SEQ ID NO: 539
  misc_feature 1..591: note = Synthetic polypeptide
  source 1..591: mol_type = other DNA

SEQ ID NO: 14781 - DNA, 482 bp, synthetic construct; identical to SEQ ID NO: 540
  misc_feature 1..482: note = Synthetic polypeptide
  source 1..482: mol_type = other DNA

SEQ ID NO: 14782 - DNA, 444 bp, synthetic construct; identical to SEQ ID NO: 541
  misc_feature 1..444: note = Synthetic polypeptide
  source 1..444: mol_type = other DNA

SEQ ID NO: 14783 - DNA, 334 bp, synthetic construct; identical to SEQ ID NO: 533
  misc_feature 1..334: note = Synthetic polypeptide
  source 1..334: mol_type = other DNA

SEQ ID NO: 14784 - DNA, 38 bp, synthetic construct; identical to SEQ ID NO: 543
  misc_feature 1..38: note = Synthetic polypeptide
  source 1..38: mol_type = other DNA

SEQ ID NO: 14785 - DNA, 245 bp, synthetic construct; identical to SEQ ID NO: 542
  misc_feature 1..245: note = Synthetic polypeptide
  source 1..245: mol_type = other DNA

SEQ ID NO: 14786 - DNA, 382 bp, synthetic construct; identical to SEQ ID NO: 434
  misc_feature 1..382: note = Synthetic polypeptide
  source 1..382: mol_type = other DNA

SEQ ID NO: 14787 - DNA, 282 bp, synthetic construct; identical to SEQ ID NO: 7621
  misc_feature 1..282: note = Synthetic polypeptide
  source 1..282: mol_type = other DNA

SEQ ID NO: 14788 - DNA, 520 bp, synthetic construct; identical to SEQ ID NO: 6424
  misc_feature 1..520: note = Synthetic polypeptide
  source 1..520: mol_type = other DNA

SEQ ID NO: 14789 - DNA, 355 bp, synthetic construct; identical to SEQ ID NO: 8039
  misc_feature 1..355: note = Synthetic polypeptide
  source 1..355: mol_type = other DNA

SEQ ID NO: 14790 - DNA, 1532 bp, synthetic construct
  misc_feature 1..1532: note = Synthetic polypeptide
  source 1..1532: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggaggtgggggtcagcccccgccaggccagccgccctgtccaggagggaggtgggggggtcagccccccacccggccagccgccccgtccaggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14791 - DNA, 1466 bp, synthetic construct
  misc_feature 1..1466: note = Synthetic polypeptide
  source 1..1466: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggaggtgggggtcagcccccgccaggccagccgccctgtccaggagggaggtgggggggtcagccccccacccggccagccgccccgtccaggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14792 - DNA, 1325 bp, synthetic construct; identical to SEQ ID NO: 7686
  misc_feature 1..1325: note = Synthetic polypeptide
  source 1..1325: mol_type = other DNA

SEQ ID NO: 14793 - DNA, 1691 bp, synthetic construct; identical to SEQ ID NO: 7687
  misc_feature 1..1691: note = Synthetic polypeptide
  source 1..1691: mol_type = other DNA

SEQ ID NO: 14794 - DNA, 1541 bp, synthetic construct; identical to SEQ ID NO: 7688
  misc_feature 1..1541: note = Synthetic polypeptide
  source 1..1541: mol_type = other DNA

SEQ ID NO: 14795 - DNA, 756 bp, synthetic construct; identical to SEQ ID NO: 8739
  misc_feature 1..756: note = Synthetic polypeptide
  source 1..756: mol_type = other DNA

SEQ ID NO: 14796 - DNA, 473 bp, synthetic construct; identical to SEQ ID NO: 13837
  misc_feature 1..473: note = Synthetic polypeptide
  source 1..473: mol_type = other DNA

SEQ ID NO: 14797 - DNA, 434 bp, synthetic construct; identical to SEQ ID NO: 8041
  misc_feature 1..434: note = Synthetic polypeptide
  source 1..434: mol_type = other DNA

SEQ ID NO: 14798 - DNA, 191 bp, synthetic construct
  misc_feature 1..191: note = Synthetic polypeptide
  source 1..191: mol_type = other DNA
gaatgaacactgaatcggaaatgtgaagcccaagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactga

SEQ ID NO: 14799 - DNA, 871 bp, synthetic construct; identical to SEQ ID NO: 437
  misc_feature 1..871: note = Synthetic polypeptide
  source 1..871: mol_type = other DNA

SEQ ID NO: 14800 - DNA, 421 bp, synthetic construct; identical to SEQ ID NO: 441
  misc_feature 1..421: note = Synthetic polypeptide
  source 1..421: mol_type = other DNA

SEQ ID NO: 14801 - DNA, 638 bp, synthetic construct; identical to SEQ ID NO: 442
  misc_feature 1..638: note = Synthetic polypeptide
  source 1..638: mol_type = other DNA

SEQ ID NO: 14802 - DNA, 337 bp, synthetic construct; identical to SEQ ID NO: 443
  misc_feature 1..337: note = Synthetic polypeptide
  source 1..337: mol_type = other DNA

SEQ ID NO: 14803 - DNA, 462 bp, synthetic construct
  misc_feature 1..462: note = Synthetic polypeptide
  source 1..462: mol_type = other DNA
cagatgtgacctgcctcaggaagaaatgtctgcctcatacacttaaatttaccctctatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataa

SEQ ID NO: 14804 - DNA, 1397 bp, synthetic construct
  misc_feature 1..1397: note = Synthetic polypeptide
  source 1..1397: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaattcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14805 - DNA, 1331 bp, synthetic construct
  misc_feature 1..1331: note = Synthetic polypeptide
  source 1..1331: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaattcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14806 - DNA, 120 bp, synthetic construct
  misc_feature 1..120: note = Synthetic polypeptide
  source 1..120: mol_type = other DNA
ggctgggcatggtggctcacacctgtaatcccagcacttcgggaggccgaggttcccaatgctccacctgcttatgagaaactctctgcagaacagtcaccaccaccttattcaccttaa

SEQ ID NO: 14807 - DNA, 1746 bp, synthetic construct
  misc_feature 1..1746: note = Synthetic polypeptide
  source 1..1746: mol_type = other DNA
tgatatagtttagctgtgtccccacccatatctcatcgtgaattccatgtcttgtgggagggactctgtgggaggaattgaatcatgggggcaggtcttttgtgtgctgttctcatgatagtgaataagtctcataagatctggtggttttataagggggagtttccctgcacaagctctctttctttgcctgccaccatccacataagatgtgacttgctcttccttgccttctgccatgattgtgaggcctccctagccatgtggaactgttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaa

SEQ ID NO: 14808 - DNA, 1503 bp, synthetic construct
  misc_feature 1..1503: note = Synthetic polypeptide
  source 1..1503: mol_type = other DNA
tgatatagtttagctgtgtccccacccatatctcatcgtgaattccatgtcttgtgggagggactctgtgggaggaattgaatcatgggggcaggtcttttgtgtgctgttctcatgatagtgaataagtctcataagatctggtggttttataagggggagtttccctgcacaagctctctttctttgcctgccaccatccacataagatgtgacttgctcttccttgccttctgccatgattgtgaggcctccctagccatgtggaactgaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaa

SEQ ID NO: 14809 - DNA, 360 bp, synthetic construct
  misc_feature 1..360: note = Synthetic polypeptide
  source 1..360: mol_type = other DNA
ggcagggtgcagtggctcacacctataataccagcactttgggaggctgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctga

SEQ ID NO: 14810 - DNA, 1708 bp, synthetic construct
  misc_feature 1..1708: note = Synthetic polypeptide
  source 1..1708: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14811 - DNA, 1687 bp, synthetic construct
  misc_feature 1..1687: note = Synthetic polypeptide
  source 1..1687: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14812 - DNA, 685 bp, synthetic construct
  misc_feature 1..685: note = Synthetic polypeptide
  source 1..685: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14813 - DNA, 589 bp, synthetic construct
  misc_feature 1..589: note = Synthetic polypeptide
  source 1..589: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 14814 - DNA, 733 bp, synthetic construct
  misc_feature 1..733: note = Synthetic polypeptide
  source 1..733: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 14815 - DNA, 745 bp, synthetic construct
  misc_feature 1..745: note = Synthetic polypeptide
  source 1..745: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 14816 - DNA, 154 bp, synthetic construct
  misc_feature 1..154: note = Synthetic polypeptide
  source 1..154: mol_type = other DNA
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttat

SEQ ID NO: 14817 - DNA, 96 bp, synthetic construct
  misc_feature 1..96: note = Synthetic polypeptide
  source 1..96: mol_type = other DNA
actgtgtttccatttccgaagataaaaggattgttggagccaggtgtggggaggacagccagtgtatccccaggaaactgacgatgcctgcatctt

SEQ ID NO: 14818 - DNA, 213 bp, synthetic construct; identical to SEQ ID NO: 7877
  misc_feature 1..213: note = Synthetic polypeptide
  source 1..213: mol_type = other DNA

SEQ ID NO: 14819 - DNA, 2477 bp, synthetic construct
  misc_feature 1..2477: note = Synthetic polypeptide
  source 1..2477: mol_type = other DNA
tgatatggtttggttctgcgtcctcacccagatctcatcttgtagctcccataatccccacatgttgtgggaaggacctggtgggagatgattgaattatggggatgggtctttcccatgctgttctcgtgatagtgaatgggtctcacaagatctgatggttttaaaaatgggaggtgccctgcacaagctctctttttgcctgctgccattcacataagatgtggcttgtccctctttgccatctgccatgattgtgaggcctccccagccatgtggaactgtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaa

SEQ ID NO: 14820 - DNA, 216 bp, synthetic construct; identical to SEQ ID NO: 8799
  misc_feature 1..216: note = Synthetic polypeptide
  source 1..216: mol_type = other DNA

SEQ ID NO: 14821 - DNA, 731 bp, synthetic construct
  misc_feature 1..731: note = Synthetic polypeptide
  source 1..731: mol_type = other DNA
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctga

SEQ ID NO: 14822 - DNA, 289 bp, synthetic construct
  misc_feature 1..289: note = Synthetic polypeptide
  source 1..289: mol_type = other DNA
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgaatcggggctgtctgtatggattggtgggcagct

SEQ ID NO: 14823 - DNA, 418 bp, synthetic construct
  misc_feature 1..418: note = Synthetic polypeptide
  source 1..418: mol_type = other DNA
tttgctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtag

SEQ ID NO: 14824 - DNA, 1691 bp, synthetic construct; identical to SEQ ID NO: 7480
  misc_feature 1..1691: note = Synthetic polypeptide
  source 1..1691: mol_type = other DNA

SEQ ID NO: 14825 - DNA, 1727 bp, synthetic construct; identical to SEQ ID NO: 7481
  misc_feature 1..1727: note = Synthetic polypeptide
  source 1..1727: mol_type = other DNA

SEQ ID NO: 14826 - DNA, 629 bp, synthetic construct; identical to SEQ ID NO: 7482
  misc_feature 1..629: note = Synthetic polypeptide
  source 1..629: mol_type = other DNA

SEQ ID NO: 14827 - DNA, 1553 bp, synthetic construct; identical to SEQ ID NO: 7483
  misc_feature 1..1553: note = Synthetic polypeptide
  source 1..1553: mol_type = other DNA

SEQ ID NO: 14828 - DNA, 96 bp, synthetic construct; identical to SEQ ID NO: 9766
  misc_feature 1..96: note = Synthetic polypeptide
  source 1..96: mol_type = other DNA

SEQ ID NO: 14829 - DNA, 678 bp, synthetic construct; identical to SEQ ID NO: 8918
  misc_feature 1..678: note = Synthetic polypeptide
  source 1..678: mol_type = other DNA

SEQ ID NO: 14830 - DNA, 726 bp, synthetic construct; identical to SEQ ID NO: 8919
  misc_feature 1..726: note = Synthetic polypeptide
  source 1..726: mol_type = other DNA

SEQ ID NO: 14831 - DNA, 1816 bp, synthetic construct
  misc_feature 1..1816: note = Synthetic polypeptide
  source 1..1816: mol_type = other DNA
tgaaactttggttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttga

SEQ ID NO: 14832 - DNA, 326 bp, synthetic construct; identical to SEQ ID NO: 6484
  misc_feature 1..326: note = Synthetic polypeptide
  source 1..326: mol_type = other DNA

SEQ ID NO: 14833 - DNA, 146 bp, synthetic construct; identical to SEQ ID NO: 6485
  misc_feature 1..146: note = Synthetic polypeptide
  source 1..146: mol_type = other DNA

SEQ ID NO: 14834 - DNA, 792 bp, synthetic construct; identical to SEQ ID NO: 6418
  misc_feature 1..792: note = Synthetic polypeptide
  source 1..792: mol_type = other DNA

SEQ ID NO: 14835 - DNA, 369 bp, synthetic construct; identical to SEQ ID NO: 6419
  misc_feature 1..369: note = Synthetic polypeptide
  source 1..369: mol_type = other DNA

SEQ ID NO: 14836 - DNA, 249 bp, synthetic construct; identical to SEQ ID NO: 6420
  misc_feature 1..249: note = Synthetic polypeptide
  source 1..249: mol_type = other DNA

SEQ ID NO: 14837 - DNA, 369 bp, synthetic construct; identical to SEQ ID NO: 6421
  misc_feature 1..369: note = Synthetic polypeptide
  source 1..369: mol_type = other DNA

SEQ ID NO: 14838 - DNA, 843 bp, synthetic construct; identical to SEQ ID NO: 6422
  misc_feature 1..843: note = Synthetic polypeptide
  source 1..843: mol_type = other DNA

SEQ ID NO: 14839 - DNA, 322 bp, synthetic construct
  misc_feature 1..322: note = Synthetic polypeptide
  source 1..322: mol_type = other DNA
ggcggcgtctagtgcctctgttaagatcgcgctctgagaaacaacgctggcattcaaatccagctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttga

SEQ ID NO: 14840 - DNA, 229 bp, synthetic construct
  misc_feature 1..229: note = Synthetic polypeptide
  source 1..229: mol_type = other DNA
gtcctgttttccacttgaaactccaagcatacctgacatataacagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14841 - DNA, 560 bp, synthetic construct; identical to SEQ ID NO: 6321
  misc_feature 1..560: note = Synthetic polypeptide
  source 1..560: mol_type = other DNA

SEQ ID NO: 14842 - DNA, 418 bp, synthetic construct; identical to SEQ ID NO: 11223
  misc_feature 1..418: note = Synthetic polypeptide
  source 1..418: mol_type = other DNA

SEQ ID NO: 14843 - DNA, 386 bp, synthetic construct; identical to SEQ ID NO: 11224
  misc_feature 1..386: note = Synthetic polypeptide
  source 1..386: mol_type = other DNA

SEQ ID NO: 14844 - DNA, 457 bp, synthetic construct; identical to SEQ ID NO: 11225
  misc_feature 1..457: note = Synthetic polypeptide
  source 1..457: mol_type = other DNA

SEQ ID NO: 14845 - DNA, 496 bp, synthetic construct; identical to SEQ ID NO: 11226
  misc_feature 1..496: note = Synthetic polypeptide
  source 1..496: mol_type = other DNA

SEQ ID NO: 14846 - DNA, 385 bp, synthetic construct; identical to SEQ ID NO: 11229
  misc_feature 1..385: note = Synthetic polypeptide
  source 1..385: mol_type = other DNA

SEQ ID NO: 14847 - DNA, 385 bp, synthetic construct; identical to SEQ ID NO: 11229
  misc_feature 1..385: note = Synthetic polypeptide
  source 1..385: mol_type = other DNA

SEQ ID NO: 14848 - DNA, 385 bp, synthetic construct; identical to SEQ ID NO: 11229
  misc_feature 1..385: note = Synthetic polypeptide
  source 1..385: mol_type = other DNA

SEQ ID NO: 14849 - DNA, 418 bp, synthetic construct; identical to SEQ ID NO: 11223
  misc_feature 1..418: note = Synthetic polypeptide
  source 1..418: mol_type = other DNA

SEQ ID NO: 14850 - DNA, 418 bp, synthetic construct; identical to SEQ ID NO: 11223
  misc_feature 1..418: note = Synthetic polypeptide
  source 1..418: mol_type = other DNA

SEQ ID NO: 14851 - DNA, 418 bp, synthetic construct; identical to SEQ ID NO: 11223
  misc_feature 1..418: note = Synthetic polypeptide
  source 1..418: mol_type = other DNA

SEQ ID NO: 14852 - DNA, 418 bp, synthetic construct; identical to SEQ ID NO: 11223
  misc_feature 1..418: note = Synthetic polypeptide
  source 1..418: mol_type = other DNA

SEQ ID NO: 14853 - DNA, 418 bp, synthetic construct; identical to SEQ ID NO: 11223
  misc_feature 1..418: note = Synthetic polypeptide
  source 1..418: mol_type = other DNA

SEQ ID NO: 14854 - DNA, 163 bp, synthetic construct; identical to SEQ ID NO: 480
  misc_feature 1..163: note = Synthetic polypeptide
  source 1..163: mol_type = other DNA

SEQ ID NO: 14855 - DNA, 104 bp, synthetic construct; identical to SEQ ID NO: 481
  misc_feature 1..104: note = Synthetic polypeptide
  source 1..104: mol_type = other DNA

SEQ ID NO: 14856 - DNA, 753 bp, synthetic construct; identical to SEQ ID NO: 7919
  misc_feature 1..753: note = Synthetic polypeptide
  source 1..753: mol_type = other DNA

SEQ ID NO: 14857 - DNA, 873 bp, synthetic construct; identical to SEQ ID NO: 7920
  misc_feature 1..873: note = Synthetic polypeptide
  source 1..873: mol_type = other DNA

SEQ ID NO: 14858 - DNA, 139 bp, synthetic construct; identical to SEQ ID NO: 8939
  misc_feature 1..139: note = Synthetic polypeptide
  source 1..139: mol_type = other DNA

SEQ ID NO: 14859 - DNA, 368 bp, synthetic construct; identical to SEQ ID NO: 8940
  misc_feature 1..368: note = Synthetic polypeptide
  source 1..368: mol_type = other DNA

SEQ ID NO: 14860 - DNA, 2192 bp, synthetic construct; identical to SEQ ID NO: 8941
  misc_feature 1..2192: note = Synthetic polypeptide
  source 1..2192: mol_type = other DNA

SEQ ID NO: 14861 - DNA, 1328 bp, synthetic construct; identical to SEQ ID NO: 8942
  misc_feature 1..1328: note = Synthetic polypeptide
  source 1..1328: mol_type = other DNA

SEQ ID NO: 14862 - DNA, 2117 bp, synthetic construct; identical to SEQ ID NO: 8943
  misc_feature 1..2117: note = Synthetic polypeptide
  source 1..2117: mol_type = other DNA

SEQ ID NO: 14863 - DNA, 1265 bp, synthetic construct; identical to SEQ ID NO: 8944
  misc_feature 1..1265: note = Synthetic polypeptide
  source 1..1265: mol_type = other DNA

SEQ ID NO: 14864 - DNA, 1331 bp, synthetic construct; identical to SEQ ID NO: 8945
  misc_feature 1..1331: note = Synthetic polypeptide
  source 1..1331: mol_type = other DNA

SEQ ID NO: 14865 - DNA, 543 bp, synthetic construct; identical to SEQ ID NO: 6496
  misc_feature 1..543: note = Synthetic polypeptide
  source 1..543: mol_type = other DNA

SEQ ID NO: 14866 - DNA, 378 bp, synthetic construct; identical to SEQ ID NO: 6497
  misc_feature 1..378: note = Synthetic polypeptide
  source 1..378: mol_type = other DNA

SEQ ID NO: 14867 - DNA, 267 bp, synthetic construct; identical to SEQ ID NO: 6498
  misc_feature 1..267: note = Synthetic polypeptide
  source 1..267: mol_type = other DNA

SEQ ID NO: 14868 - DNA, 416 bp, synthetic construct; identical to SEQ ID NO: 6499
  misc_feature 1..416: note = Synthetic polypeptide
  source 1..416: mol_type = other DNA

SEQ ID NO: 14869 - DNA, 162 bp, synthetic construct; identical to SEQ ID NO: 6500
  misc_feature 1..162: note = Synthetic polypeptide
  source 1..162: mol_type = other DNA

SEQ ID NO: 14870 - DNA, 763 bp, synthetic construct; identical to SEQ ID NO: 606
  misc_feature 1..763: note = Synthetic polypeptide
  source 1..763: mol_type = other DNA

SEQ ID NO: 14871 - DNA, 1196 bp, synthetic construct
  misc_feature 1..1196: note = Synthetic polypeptide
  source 1..1196: mol_type = other DNA
tgtggtggatacaggagatgcgctgcccagatctgcccccagggaaggaccctgctccagctgttggaggccggctggcccacagcctctagcagtcaagctcttttggctggaaagccgcttgcaggaaatcactccatggaggtgcagagataaggccccagacattttggcccagtatgggacaactttgaccgtctttttcagcttcaggactcccatggagttggaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaa

SEQ ID NO: 14872 - DNA, 807 bp, synthetic construct; identical to SEQ ID NO: 7401
  misc_feature 1..807: note = Synthetic polypeptide
  source 1..807: mol_type = other DNA

SEQ ID NO: 14873 - DNA, 453 bp, synthetic construct; identical to SEQ ID NO: 7402
  misc_feature 1..453: note = Synthetic polypeptide
  source 1..453: mol_type = other DNA

SEQ ID NO: 14874 - DNA, 976 bp, synthetic construct
  misc_feature 1..976: note = Synthetic polypeptide
  source 1..976: mol_type = other DNA
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctag

SEQ ID NO: 14875 - DNA, 694 bp, synthetic construct
  misc_feature 1..694: note = Synthetic polypeptide
  source 1..694: mol_type = other DNA
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctag

SEQ ID NO: 14876 - DNA, 247 bp, synthetic construct
  misc_feature 1..247: note = Synthetic polypeptide
  source 1..247: mol_type = other DNA
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggggccacggattcggctgtgccctgtgccctgctgctggagctggcccaagcacttgacctggagctga

SEQ ID NO: 14877 - DNA, 947 bp, synthetic construct; identical to SEQ ID NO: 6434
  misc_feature 1..947: note = Synthetic polypeptide
  source 1..947: mol_type = other DNA

SEQ ID NO: 14878 - DNA, 881 bp, synthetic construct; identical to SEQ ID NO: 6435
  misc_feature 1..881: note = Synthetic polypeptide
  source 1..881: mol_type = other DNA

SEQ ID NO: 14879 - DNA, 797 bp, synthetic construct
  misc_feature 1..797: note = Synthetic polypeptide
  source 1..797: mol_type = other DNA
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 14880 - DNA, 552 bp, synthetic construct
  misc_feature 1..552: note = Synthetic polypeptide
  source 1..552: mol_type = other DNA
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttga

SEQ ID NO: 14881 - DNA, 819 bp, synthetic construct
  misc_feature 1..819: note = Synthetic polypeptide
  source 1..819: mol_type = other DNA
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactga

SEQ ID NO: 14882 - DNA, 368 bp, synthetic construct; identical to SEQ ID NO: 6482
  misc_feature 1..368: note = Synthetic polypeptide
  source 1..368: mol_type = other DNA

SEQ ID NO: 14883 - DNA, 356 bp, synthetic construct
  misc_feature 1..356: note = Synthetic polypeptide
  source 1..356: mol_type = other DNA
tgatatggtttgtgtccccagccaaatctcatcttgaattgtagttcccataatccccacgtgtcatgggagggacccagtgggaggtaattgaatcatggggatgattactaacctcatggtgttctcgtgatagtgagttctcacaagatctgatggttttataaggagcttttcccccttttgctctgcacttcttgctgctgccatgtgaaggacatgtttgcttccccttctgccatgattcagtccctggaggaggattgtgtgtccattttacagctggagaagccgagatccagaaaggacccccaagttgtgggcagaataaatctacagcagcttttaactattaa

SEQ ID NO: 14884 - DNA, 333 bp, synthetic construct; identical to SEQ ID NO: 6583
  misc_feature 1..333: note = Synthetic polypeptide
  source 1..333: mol_type = other DNA

SEQ ID NO: 14885 - DNA, 1883 bp, synthetic construct; identical to SEQ ID NO: 6345
  misc_feature 1..1883: note = Synthetic polypeptide
  source 1..1883: mol_type = other DNA

SEQ ID NO: 14886 - DNA, 1045 bp, synthetic construct; identical to SEQ ID NO: 8898
  misc_feature 1..1045: note = Synthetic polypeptide
  source 1..1045: mol_type = other DNA

SEQ ID NO: 14887 - DNA, 742 bp, synthetic construct; identical to SEQ ID NO: 6357
  misc_feature 1..742: note = Synthetic polypeptide
  source 1..742: mol_type = other DNA

SEQ ID NO: 14888 - DNA, 590 bp, synthetic construct; identical to SEQ ID NO: 6358
  misc_feature 1..590: note = Synthetic polypeptide
  source 1..590: mol_type = other DNA

SEQ ID NO: 14889 - DNA, 577 bp, synthetic construct; identical to SEQ ID NO: 6359
  misc_feature 1..577: note = Synthetic polypeptide
  source 1..577: mol_type = other DNA

SEQ ID NO: 14890 - DNA, 430 bp, synthetic construct; identical to SEQ ID NO: 6360
  misc_feature 1..430: note = Synthetic polypeptide
  source 1..430: mol_type = other DNA

SEQ ID NO: 14891 - DNA, 670 bp, synthetic construct; identical to SEQ ID NO: 6361
  misc_feature 1..670: note = Synthetic polypeptide
  source 1..670: mol_type = other DNA

SEQ ID NO: 14892 - DNA, 1062 bp, synthetic construct
  misc_feature 1..1062: note = Synthetic polypeptide
  source 1..1062: mol_type = other DNA
caggggtccccaatcccaagcctggtccgagacctgttaggaacagggcatcgcagcaggagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctga

SEQ ID NO: 14893 - DNA, 80 bp, synthetic construct
  misc_feature 1..80: note = Synthetic polypeptide
  source 1..80: mol_type = other DNA
caggggtccccaatcccaagcctggtccgagacctgttaggaacagggcatcgcagcaggagggacaccacatcatttga

SEQ ID NO: 14894 - DNA, 3083 bp, synthetic construct
  misc_feature 1..3083: note = Synthetic polypeptide
  source 1..3083: mol_type = other DNA
tgatatggtttggctccgtgtccccaaccaaatctcatgttgaattgtaatacccagtgttggaggtgggacctggtgggaggtgattggatcatgggggtggtttctgatggtttagcaccatcctgctcgtgctgtctcatgatagagttctcacaagatctggctgtttaaaagtgtgtagcacctccccctttgccctcttcctccttctctggacacataagacatgcctgcttccccttcaccttccaccatgattgtaagtttcctgaagcctccccagccatgcttcctatacagcctgcagaactgtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaa

SEQ ID NO: 14895 - DNA, 3014 bp, synthetic construct
  misc_feature 1..3014: note = Synthetic polypeptide
  source 1..3014: mol_type = other DNA
tgatatggtttggctccgtgtccccaaccaaatctcatgttgaattgtaatacccagtgttggaggtgggacctggtgggaggtgattggatcatgggggtggtttctgatggtttagcaccatcctgctcgtgctgtctcatgatagagttctcacaagatctggctgtttaaaagtgtgtagcacctccccctttgccctcttcctccttctctggacacataagacatgcctgcttccccttcaccttccaccatgattgtaagtttcctgaagcctccccagccatgcttcctatacagcctgcagaactgtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaa

SEQ ID NO: 14896 - DNA, 2169 bp, synthetic construct
  misc_feature 1..2169: note = Synthetic polypeptide
  source 1..2169: mol_type = other DNA
tgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtagagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggaacagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctag

SEQ ID NO: 14897 - DNA, 1432 bp, synthetic construct
  misc_feature 1..1432: note = Synthetic polypeptide
  source 1..1432: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctga

SEQ ID NO: 14898 - DNA, 1618 bp, synthetic construct
  misc_feature 1..1618: note = Synthetic polypeptide
  source 1..1618: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaa

SEQ ID NO: 14899 - DNA, 1708 bp, synthetic construct
  misc_feature 1..1708: note = Synthetic polypeptide
  source 1..1708: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaa

SEQ ID NO: 14900 - DNA, 1558 bp, synthetic construct
  misc_feature 1..1558: note = Synthetic polypeptide
  source 1..1558: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccagagcccccagaactgcagcatcatgtaa

SEQ ID NO: 14901 - DNA, 1774 bp, synthetic construct
  misc_feature 1..1774: note = Synthetic polypeptide
  source 1..1774: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatacaagagatgggaatgaggtgggaggtggaagaagggagaagaaaggtgagtttgagctgccttccctag

SEQ ID NO: 14902 - DNA, 508 bp, synthetic construct
  misc_feature 1..508: note = Synthetic polypeptide
  source 1..508: mol_type = other DNA
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaag

SEQ ID NO: 14903 - DNA, 80 bp, synthetic construct; identical to SEQ ID NO: 6364
  misc_feature 1..80: note = Synthetic polypeptide
  source 1..80: mol_type = other DNA

SEQ ID NO: 14904 - DNA, 217 bp, synthetic construct; identical to SEQ ID NO: 6365
  misc_feature 1..217: note = Synthetic polypeptide
  source 1..217: mol_type = other DNA

SEQ ID NO: 14905 - DNA, 1320 bp, synthetic construct; identical to SEQ ID NO: 8817
  misc_feature 1..1320: note = Synthetic polypeptide
  source 1..1320: mol_type = other DNA

SEQ ID NO: 14906 - DNA, 420 bp, synthetic construct; identical to SEQ ID NO: 8818
  misc_feature 1..420: note = Synthetic polypeptide
  source 1..420: mol_type = other DNA

SEQ ID NO: 14907 - DNA, 1101 bp, synthetic construct; identical to SEQ ID NO: 8142
  misc_feature 1..1101: note = Synthetic polypeptide
  source 1..1101: mol_type = other DNA

SEQ ID NO: 14908 - DNA, 1896 bp, synthetic construct; identical to SEQ ID NO: 8143
  misc_feature 1..1896: note = Synthetic polypeptide
  source 1..1896: mol_type = other DNA

SEQ ID NO: 14909 - DNA, 1662 bp, synthetic construct; identical to SEQ ID NO: 8144
  misc_feature 1..1662: note = Synthetic polypeptide
  source 1..1662: mol_type = other DNA

SEQ ID NO: 14910 - DNA, 630 bp, synthetic construct
  misc_feature 1..630: note = Synthetic polypeptide
  source 1..630: mol_type = other DNA
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctga

SEQ ID NO: 14911 - DNA, 360 bp, synthetic construct
  misc_feature 1..360: note = Synthetic polypeptide
  source 1..360: mol_type = other DNA
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaagggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctga

SEQ ID NO: 14912 - DNA, 858 bp, synthetic construct
  misc_feature 1..858: note = Synthetic polypeptide
  source 1..858: mol_type = other DNA
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctga

SEQ ID NO: 14913 - DNA, 768 bp, synthetic construct
  misc_feature 1..768: note = Synthetic polypeptide
  source 1..768: mol_type = other DNA
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctga

SEQ ID NO: 14914 - DNA, 428 bp, synthetic construct
  misc_feature 1..428: note = Synthetic polypeptide
  source 1..428: mol_type = other DNA
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggc

SEQ ID NO: 14915 - DNA, 630 bp, synthetic construct; identical to SEQ ID NO: 9907
  misc_feature 1..630: note = Synthetic polypeptide
  source 1..630: mol_type = other DNA

SEQ ID NO: 14916 - DNA, 711 bp, synthetic construct; identical to SEQ ID NO: 9908
  misc_feature 1..711: note = Synthetic polypeptide
  source 1..711: mol_type = other DNA

SEQ ID NO: 14917 - DNA, 913 bp, synthetic construct; identical to SEQ ID NO: 13870
  misc_feature 1..913: note = Synthetic polypeptide
  source 1..913: mol_type = other DNA

SEQ ID NO: 14918 - DNA, 169 bp, synthetic construct; identical to SEQ ID NO: 13871
  misc_feature 1..169: note = Synthetic polypeptide
  source 1..169: mol_type = other DNA

SEQ ID NO: 14919 - DNA, 1469 bp, synthetic construct; identical to SEQ ID NO: 10631
  misc_feature 1..1469: note = Synthetic polypeptide
  source 1..1469: mol_type = other DNA

SEQ ID NO: 14920 - DNA, 1067 bp, synthetic construct; identical to SEQ ID NO: 9936
  misc_feature 1..1067: note = Synthetic polypeptide
  source 1..1067: mol_type = other DNA

SEQ ID NO: 14921 - DNA, 968 bp, synthetic construct; identical to SEQ ID NO: 9937
  misc_feature 1..968: note = Synthetic polypeptide
  source 1..968: mol_type = other DNA

SEQ ID NO: 14922 - DNA, 459 bp, synthetic construct; identical to SEQ ID NO: 6625
  misc_feature 1..459: note = Synthetic polypeptide
  source 1..459: mol_type = other DNA

SEQ ID NO: 14923 - DNA, 490 bp, synthetic construct
  misc_feature 1..490: note = Synthetic polypeptide
  source 1..490: mol_type = other DNA
ctccttgtctttgctcatgctgtgcccttacctggaatgcctttttcccattccttgttattaataaaatcttccaaggccctacttaaatgtcctctctgaatgaagccttccttgattctccccccaccctccaaatgacttgctgccgcttctgttcatagagcgcttcgtttatatccccagagcactcattactctctgacttgtctgtccccctgttagattcctggagggaaccgaacatgcctaaatcacctgtttctgaccagcactgtaggtattcagtgttcgagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttga

SEQ ID NO: 14924 - DNA, 665 bp, synthetic construct; identical to SEQ ID NO: 6374
  misc_feature 1..665: note = Synthetic polypeptide
  source 1..665: mol_type = other DNA

SEQ ID NO: 14925 - DNA, 518 bp, synthetic construct; identical to SEQ ID NO: 6375
  misc_feature 1..518: note = Synthetic polypeptide
  source 1..518: mol_type = other DNA

SEQ ID NO: 14926 - DNA, 409 bp, synthetic construct
  misc_feature 1..409: note = Synthetic polypeptide
  source 1..409: mol_type = other DNA
ggaaccttaatgaggtgagaccctccaacccagaggaaatacactgtgcagcaccaattggccaactttggatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 14927 - DNA, 1500 bp, synthetic construct; identical to SEQ ID NO: 9786
  misc_feature 1..1500: note = Synthetic polypeptide
  source 1..1500: mol_type = other DNA

SEQ ID NO: 14928 - DNA, 168 bp, synthetic construct; identical to SEQ ID NO: 8710
  misc_feature 1..168: note = Synthetic polypeptide
  source 1..168: mol_type = other DNA

SEQ ID NO: 14929 - DNA, 560 bp, synthetic construct; identical to SEQ ID NO: 6322
  misc_feature 1..560: note = Synthetic polypeptide
  source 1..560: mol_type = other DNA

SEQ ID NO: 14930 - DNA, 621 bp, synthetic construct
  misc_feature 1..621: note = Synthetic polypeptide
  source 1..621: mol_type = other DNA
ggctggctgcagtggctcacacttttgatgccaccactttgggaggctgagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 14931 - DNA, 768 bp, synthetic construct
  misc_feature 1..768: note = Synthetic polypeptide
  source 1..768: mol_type = other DNA
ggctggctgcagtggctcacacttttgatgccaccactttgggaggctgagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 14932 - DNA, 1220 bp, synthetic construct
  misc_feature 1..1220: note = Synthetic polypeptide
  source 1..1220: mol_type = other DNA
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14933 - DNA, 1139 bp, synthetic construct
  misc_feature 1..1139: note = Synthetic polypeptide
  source 1..1139: mol_type = other DNA
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14934 - DNA, 1160 bp, synthetic construct
  misc_feature 1..1160: note = Synthetic polypeptide
  source 1..1160: mol_type = other DNA
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14935 - DNA, 769 bp, synthetic construct; identical to SEQ ID NO: 6486
  misc_feature 1..769: note = Synthetic polypeptide
  source 1..769: mol_type = other DNA

SEQ ID NO: 14936 - DNA, 575 bp, synthetic construct
  misc_feature 1..575: note = Synthetic polypeptide
  source 1..575: mol_type = other DNA
ggccgggcgcagtggctcacacctgtaatcccagtactttgggaggccaaggggaggatcacctgaggtcaggagttcgagaccagcctgggcaatatggtgaaacccccgtctctacaaaaaattagccagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtga

SEQ ID NO: 14937 - DNA, 168 bp, synthetic construct
  misc_feature 1..168: note = Synthetic polypeptide
  source 1..168: mol_type = other DNA
ggccgggcgcagtggctcacacctgtaatcccagtactttgggaggccaaggggaggatcacctgaggtcaggagttcgagaccagcctgggcaatatggtgaaacccccgtctctacaaaaaattagccagatcccagctctcctgttggcttcgtgcttggggtag

SEQ ID NO: 14938 - DNA, 839 bp, synthetic construct; identical to SEQ ID NO: 9123
  misc_feature 1..839: note = Synthetic polypeptide
  source 1..839: mol_type = other DNA

SEQ ID NO: 14939 - DNA, 280 bp, synthetic construct
  misc_feature 1..280: note = Synthetic polypeptide
  source 1..280: mol_type = other DNA
cagatgtgacctgcctcaggaagaaatgtctgcctcatacacttaaatttaccctcacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataa

SEQ ID NO: 14940 - DNA, 1304 bp, synthetic construct; identical to SEQ ID NO: 9787
  misc_feature 1..1304: note = Synthetic polypeptide
  source 1..1304: mol_type = other DNA

SEQ ID NO: 14941 - DNA, 1403 bp, synthetic construct; identical to SEQ ID NO: 9788
  misc_feature 1..1403: note = Synthetic polypeptide
  source 1..1403: mol_type = other DNA

SEQ ID NO: 14942 - DNA, 1355 bp, synthetic construct; identical to SEQ ID NO: 9789
  misc_feature 1..1355: note = Synthetic polypeptide
  source 1..1355: mol_type = other DNA

SEQ ID NO: 14943 - DNA, 698 bp, synthetic construct; identical to SEQ ID NO: 9922
  misc_feature 1..698: note = Synthetic polypeptide
  source 1..698: mol_type = other DNA

SEQ ID NO: 14944 - DNA, 779 bp, synthetic construct; identical to SEQ ID NO: 9923
  misc_feature 1..779: note = Synthetic polypeptide
  source 1..779: mol_type = other DNA

SEQ ID NO: 14945 - DNA, 2109 bp, synthetic construct
  misc_feature 1..2109: note = Synthetic polypeptide
  source 1..2109: mol_type = other DNA
ctggaatgttgctgcagcacctgtctgccagcttccaccctgggccccaatcgtgtcctcagcaccacaacagagggatcctccaacagctcagccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttga

SEQ ID NO: 14946 - DNA, 713 bp, synthetic construct
  misc_feature 1..713: note = Synthetic polypeptide
  source 1..713: mol_type = other DNA
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctga

SEQ ID NO: 14947 - DNA, 308 bp, synthetic construct
  misc_feature 1..308: note = Synthetic polypeptide
  source 1..308: mol_type = other DNA
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggttctggctccttggcagcaatggctgtatttga

SEQ ID NO: 14948 - DNA, 510 bp, synthetic construct
  misc_feature 1..510: note = Synthetic polypeptide
  source 1..510: mol_type = other DNA
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 14949 - DNA, 2133 bp, synthetic construct
  misc_feature 1..2133: note = Synthetic polypeptide
  source 1..2133: mol_type = other DNA
tgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtagagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggaacagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctag

SEQ ID NO: 14950 - DNA, 1084 bp, synthetic construct; identical to SEQ ID NO: 580
  misc_feature 1..1084: note = Synthetic polypeptide
  source 1..1084: mol_type = other DNA

SEQ ID NO: 14951 - DNA, 2825 bp, synthetic construct
  misc_feature 1..2825: note = Synthetic polypeptide
  source 1..2825: mol_type = other DNA
attgcttctcggccttttggctaagatcaagtgttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 14952 - DNA, 614 bp, synthetic construct
  misc_feature 1..614: note = Synthetic polypeptide
  source 1..614: mol_type = other DNA
aaattggagtttcactgaagaataagaaactcactcaaaaccacacaactacatggaaattgaacaaccttctcctgaatgactcctgggtaaataatgaaatcaaggcagaaatcaagaagttctttgaaaccaaagagaacaaagaaaacctctgggatgcagctaaagcagtggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 14953 - DNA, 2162 bp, synthetic construct; identical to SEQ ID NO: 14719
  misc_feature 1..2162: note = Synthetic polypeptide
  source 1..2162: mol_type = other DNA

SEQ ID NO: 14954 - DNA, 1541 bp, synthetic construct; identical to SEQ ID NO: 14720
  misc_feature 1..1541: note = Synthetic polypeptide
  source 1..1541: mol_type = other DNA

SEQ ID NO: 14955 - DNA, 401 bp, synthetic construct; identical to SEQ ID NO: 14721
  misc_feature 1..401: note = Synthetic polypeptide
  source 1..401: mol_type = other DNA

SEQ ID NO: 14956 - DNA, 443 bp, synthetic construct; identical to SEQ ID NO: 14722
  misc_feature 1..443: note = Synthetic polypeptide
  source 1..443: mol_type = other DNA

SEQ ID NO: 14957 - DNA, 472 bp, synthetic construct
  misc_feature 1..472: note = Synthetic polypeptide
  source 1..472: mol_type = other DNA
tgatgtggtttggctgtgtccccgctaaaatctcaacttgaattgtatctcccagaattcccatgtgttgtgggagggacccagggggagttaactgaatcatgggggccggtctttcctgtgctattctggtgatagtgaataagtctcacgagatctgatgggtttatcaggggtttccacttttctgtctccctcattttctcttgctgccaccatgtaagaagtgcttttcacctccccccatgattccgaggcctccccagccacatggaactaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaa

SEQ ID NO: 14958 - DNA, 367 bp, synthetic construct; identical to SEQ ID NO: 548
  misc_feature 1..367: note = Synthetic polypeptide
  source 1..367: mol_type = other DNA

SEQ ID NO: 14959 - DNA, 1055 bp, synthetic construct
  misc_feature 1..1055: note = Synthetic polypeptide
  source 1..1055: mol_type = other DNA
gccctgagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaa

SEQ ID NO: 14960 - DNA, 157 bp, synthetic construct
  misc_feature 1..157: note = Synthetic polypeptide
  source 1..157: mol_type = other DNA
ggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccagaagactcactccatag

SEQ ID NO: 14961 - DNA, 757 bp, synthetic construct
  misc_feature 1..757: note = Synthetic polypeptide
  source 1..757: mol_type = other DNA
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctga

SEQ ID NO: 14962 - DNA, 622 bp, synthetic construct
  misc_feature 1..622: note = Synthetic polypeptide
  source 1..622: mol_type = other DNA
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaaggcaatacagtacggtactgaggataacagtactgcagtagtagtgccttttggtgcctggggaaaatataagaactctgaaatcaacttctcattcagcagaagctttgcctccagtggacgatgggcctga

SEQ ID NO: 14963 - DNA, 340 bp, synthetic construct
  misc_feature 1..340: note = Synthetic polypeptide
  source 1..340: mol_type = other DNA
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattag

SEQ ID NO: 14964 - DNA, 187 bp, synthetic construct
  misc_feature 1..187: note = Synthetic polypeptide
  source 1..187: mol_type = other DNA
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatggtatgtaa

SEQ ID NO: 14965 - DNA, 2051 bp, synthetic construct
  misc_feature 1..2051: note = Synthetic polypeptide
  source 1..2051: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14966 - DNA, 2030 bp, synthetic construct
  misc_feature 1..2030: note = Synthetic polypeptide
  source 1..2030: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14967 - DNA, 2051 bp, synthetic construct
  misc_feature 1..2051: note = Synthetic polypeptide
  source 1..2051: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14968 - DNA, 1925 bp, synthetic construct
  misc_feature 1..1925: note = Synthetic polypeptide
  source 1..1925: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14969 - DNA, 932 bp, synthetic construct
  misc_feature 1..932: note = Synthetic polypeptide
  source 1..932: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 14970 - DNA, 1076 bp, synthetic construct
  misc_feature 1..1076: note = Synthetic polypeptide
  source 1..1076: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 14971 - DNA, 941 bp, synthetic construct
  misc_feature 1..941: note = Synthetic polypeptide
  source 1..941: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 14972 - DNA, 497 bp, synthetic construct
  misc_feature 1..497: note = Synthetic polypeptide
  source 1..497: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 14973 - DNA, 439 bp, synthetic construct
  misc_feature 1..439: note = Synthetic polypeptide
  source 1..439: mol_type = other DNA
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 14974 - DNA, 1441 bp, synthetic construct
  misc_feature 1..1441: note = Synthetic polypeptide
  source 1..1441: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14975 - DNA, 1375 bp, synthetic construct
  misc_feature 1..1375: note = Synthetic polypeptide
  source 1..1375: mol_type = other DNA
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14976 - DNA, 170 bp, synthetic construct
  misc_feature 1..170: note = Synthetic polypeptide
  source 1..170: mol_type = other DNA
ggctgggcatggtggctcacacctgtaatcccagcacttcgggaggccgaggtgggtggatcacctgatctcaggagctcgagaccagcctggcaaacatggttcccaatgctccacctgcttatgagaaactctctgcagaacagtcaccaccaccttattcaccttaa

SEQ ID NO: 14977 - DNA, 359 bp, synthetic construct
  misc_feature 1..359: note = Synthetic polypeptide
  source 1..359: mol_type = other DNA
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggaggaaactgaagagacatcctcacaagagtctgccgaagaggactag

SEQ ID NO: 14978 - DNA, 329 bp, synthetic construct
  misc_feature 1..329: note = Synthetic polypeptide
  source 1..329: mol_type = other DNA
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggtaagacatagtcattaa

SEQ ID NO: 14979 - DNA, 386 bp, synthetic construct
  misc_feature 1..386: note = Synthetic polypeptide
  source 1..386: mol_type = other DNA
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggtcaatgttgccttgcctgggaaggaccacccgggcaatcttatatatctactgttctctaaaaatgccacttag

SEQ ID NO: 14980 - DNA, 899 bp, synthetic construct
  misc_feature 1..899: note = Synthetic polypeptide
  source 1..899: mol_type = other DNA
gaattccaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctag

SEQ ID NO: 14981 - DNA, 95 bp, synthetic construct
  misc_feature 1..95: note = Synthetic polypeptide
  source 1..95: mol_type = other DNA
gaattccaatagtccttatcagtggcagaagatccttctgtagtatattttcagtgctgccgtatcgcgacagtacccaagtcggacaacagtga

SEQ ID NO: 14982 - DNA, 149 bp, synthetic construct
  misc_feature 1..149: note = Synthetic polypeptide
  source 1..149: mol_type = other DNA
gaattccaatagtccttatcagtggcagaagatccttctgtagtatattttcagtgctgccgtatcgcgacagtacccaagtcgggtatgtatatgcatgcatgctttgtagttctctgggtgaaaagatctcacaccaatgtacataa

SEQ ID NO: 14983 - DNA, 2073 bp, synthetic construct
  misc_feature 1..2073: note = Synthetic polypeptide
  source 1..2073: mol_type = other DNA
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcagagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 14984 - DNA, 117 bp, synthetic construct; identical to SEQ ID NO: 9461
  misc_feature 1..117: note = Synthetic polypeptide
  source 1..117: mol_type = other DNA

SEQ ID NO: 14985 - DNA, 1412 bp, synthetic construct
  misc_feature 1..1412: note = Synthetic polypeptide
  source 1..1412: mol_type = other DNA
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagggaatgcccaaggcgtcattcaataatgaatctagtttgagagaattgtcaggaacgccaaatttactgaatacaagtgactcagagcaggctcagaaaccagtgtcccctcctggagaagcaagtacctctggacagcactctagactaaaactggaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtctggggatgagtatggccaggaactgggcatcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttga

SEQ ID NO: 14986 - DNA, 350 bp, synthetic construct
  misc_feature 1..350: note = Synthetic polypeptide
  source 1..350: mol_type = other DNA
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagattgtgagatgtgtcagaacttcttcattgacagctgtgctgctcatgggccccctacatttgtaa

SEQ ID NO: 14987 - DNA, 279 bp, synthetic construct
  misc_feature 1..279: note = Synthetic polypeptide
  source 1..279: mol_type = other DNA
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagacagagtttcgctcttgtcaccccggctggagtgcaatggcgtga

SEQ ID NO: 14988 - DNA, 6107 bp, synthetic construct
  misc_feature 1..6107: note = Synthetic polypeptide
  source 1..6107: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14989 - DNA, 6026 bp, synthetic construct
  misc_feature 1..6026: note = Synthetic polypeptide
  source 1..6026: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14990 - DNA, 6182 bp, synthetic construct
  misc_feature 1..6182: note = Synthetic polypeptide
  source 1..6182: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14991 - DNA, 6098 bp, synthetic construct
  misc_feature 1..6098: note = Synthetic polypeptide
  source 1..6098: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14992 - DNA, 6101 bp, synthetic construct
  misc_feature 1..6101: note = Synthetic polypeptide
  source 1..6101: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14993 - DNA, 683 bp, synthetic construct
  misc_feature 1..683: note = Synthetic polypeptide
  source 1..683: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggtatag

SEQ ID NO: 14994 - DNA, 3222 bp, synthetic construct; identical to SEQ ID NO: 14669
  misc_feature 1..3222: note = Synthetic polypeptide
  source 1..3222: mol_type = other DNA

SEQ ID NO: 14995 - DNA, 1287 bp, synthetic construct; identical to SEQ ID NO: 14670
  misc_feature 1..1287: note = Synthetic polypeptide
  source 1..1287: mol_type = other DNA

SEQ ID NO: 14996 - DNA, 6602 bp, synthetic construct
  misc_feature 1..6602: note = Synthetic polypeptide
  source 1..6602: mol_type = other DNA
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 14997 - DNA, 5960 bp, synthetic construct
  misc_feature 1..5960: note = Synthetic polypeptide
  source 1..5960: mol_type = other DNA
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 14998 - DNA, 3305 bp, synthetic construct
  misc_feature 1..3305: note = Synthetic polypeptide
  source 1..3305: mol_type = other DNA
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacagctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 14999 - DNA, 2693 bp, synthetic construct
  misc_feature 1..2693: note = Synthetic polypeptide
  source 1..2693: mol_type = other DNA
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtag

SEQ ID NO: 15000 - DNA, 2201 bp, synthetic construct
  misc_feature 1..2201: note = Synthetic polypeptide
  source 1..2201: mol_type = other DNA
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaa

SEQ ID NO: 15001 - DNA, 232 bp, synthetic construct
  misc_feature 1..232: note = Synthetic polypeptide
  source 1..232: mol_type = other DNA
gtgaggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttccagcagggcttcagtga

SEQ ID NO: 15002 - DNA, 277 bp, synthetic construct
  misc_feature 1..277: note = Synthetic polypeptide
  source 1..277: mol_type = other DNA
gtgaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatga

SEQ ID NO: 15003 - DNA, 172 bp, synthetic construct
  misc_feature 1..172: note = Synthetic polypeptide
  source 1..172: mol_type = other DNA
gtgaggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtga

SEQ ID NO: 15004 - DNA, 728 bp, synthetic construct
  misc_feature 1..728: note = Synthetic polypeptide
  source 1..728: mol_type = other DNA
tgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactga

SEQ ID NO: 15005 - DNA, 948 bp, synthetic construct
  misc_feature 1..948: note = Synthetic polypeptide
  source 1..948: mol_type = other DNA
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagaaaacaaaaaaaaggacagcaatcccaattcctgcaaagccgtaa

SEQ ID NO: 15006 - DNA, 1287 bp, synthetic construct
  misc_feature 1..1287: note = Synthetic polypeptide
  source 1..1287: mol_type = other DNA
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 15007 - DNA, 1161 bp, synthetic construct
  misc_feature 1..1161: note = Synthetic polypeptide
  source 1..1161: mol_type = other DNA
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 15008 - DNA, 2738 bp, synthetic construct; identical to SEQ ID NO: 13465
  misc_feature 1..2738: note = Synthetic polypeptide
  source 1..2738: mol_type = other DNA

SEQ ID NO: 15009 - DNA, 629 bp, synthetic construct; identical to SEQ ID NO: 13466
  misc_feature 1..629: note = Synthetic polypeptide
  source 1..629: mol_type = other DNA

SEQ ID NO: 15010 - DNA, 918 bp, synthetic construct; identical to SEQ ID NO: 13467
  misc_feature 1..918: note = Synthetic polypeptide
  source 1..918: mol_type = other DNA

SEQ ID NO: 15011 - DNA, 740 bp, synthetic construct
  misc_feature 1..740: note = Synthetic polypeptide
  source 1..740: mol_type = other DNA
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 15012 - DNA, 719 bp, synthetic construct
  misc_feature 1..719: note = Synthetic polypeptide
  source 1..719: mol_type = other DNA
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 15013 - DNA, 552 bp, synthetic construct
  misc_feature 1..552: note = Synthetic polypeptide
  source 1..552: mol_type = other DNA
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcg

SEQ ID NO: 15014 - DNA, 194 bp, synthetic construct
  misc_feature 1..194: note = Synthetic polypeptide
  source 1..194: mol_type = other DNA
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 15015 - DNA, 572 bp, synthetic construct
  misc_feature 1..572: note = Synthetic polypeptide
  source 1..572: mol_type = other DNA
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttccagcagggcttcagtga

SEQ ID NO: 15016 - DNA, 617 bp, synthetic construct
  misc_feature 1..617: note = Synthetic polypeptide
  source 1..617: mol_type = other DNA
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatga

SEQ ID NO: 15017 - DNA, 512 bp, synthetic construct
  misc_feature 1..512: note = Synthetic polypeptide
  source 1..512: mol_type = other DNA
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtga

SEQ ID NO: 15018 - DNA, 6263 bp, synthetic construct
  misc_feature 1..6263: note = Synthetic polypeptide
  source 1..6263: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15019 - DNA, 6182 bp, synthetic construct
  misc_feature 1..6182: note = Synthetic polypeptide
  source 1..6182: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15020 - DNA, 6338 bp, synthetic construct
  misc_feature 1..6338: note = Synthetic polypeptide
  source 1..6338: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15021 - DNA, 6254 bp, synthetic construct
  misc_feature 1..6254: note = Synthetic polypeptide
  source 1..6254: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15022 - DNA, 6257 bp, synthetic construct
  misc_feature 1..6257: note = Synthetic polypeptide
  source 1..6257: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15023 - DNA, 839 bp, synthetic construct
  misc_feature 1..839: note = Synthetic polypeptide
  source 1..839: mol_type = other DNA
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggtatag

SEQ ID NO: 15024 - DNA, 1257 bp, synthetic construct; identical to SEQ ID NO: 625
  misc_feature 1..1257: note = Synthetic polypeptide
  source 1..1257: mol_type = other DNA

SEQ ID NO: 15025 - DNA, 1215 bp, synthetic construct; identical to SEQ ID NO: 626
  misc_feature 1..1215: note = Synthetic polypeptide
  source 1..1215: mol_type = other DNA

SEQ ID NO: 15026 - DNA, 507 bp, synthetic construct; identical to SEQ ID NO: 628
  misc_feature 1..507: note = Synthetic polypeptide
  source 1..507: mol_type = other DNA

SEQ ID NO: 15027 - DNA, 313 bp, synthetic construct; identical to SEQ ID NO: 629
  misc_feature 1..313: note = Synthetic polypeptide
  source 1..313: mol_type = other DNA

SEQ ID NO: 15028 - DNA, 291 bp, synthetic construct; identical to SEQ ID NO: 630
  misc_feature 1..291: note = Synthetic polypeptide
  source 1..291: mol_type = other DNA

SEQ ID NO: 15029 - DNA, 1522 bp, synthetic construct
  misc_feature 1..1522: note = Synthetic polypeptide
  source 1..1522: mol_type = other DNA
tttcctggttccctgactgggaagtgaggtgattggtggatggtcgaggcagctccttaggtgacttaagcctgccctgtggaacattccggtgggggactctggccagcccgagcaacgtggatcctgagagcactcccaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 15030 - DNA, 767 bp, synthetic construct
  misc_feature 1..767: note = Synthetic polypeptide
  source 1..767: mol_type = other DNA
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgtaagtttcctaaggcctccccagccatgctgaattgaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctga

SEQ ID NO: 15031 - DNA, 325 bp, synthetic construct
  misc_feature 1..325: note = Synthetic polypeptide
  source 1..325: mol_type = other DNA
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgtaagtttcctaaggcctccccagccatgctgaattgaatcggggctgtctgtatggattggtgggcagct

SEQ ID NO: 15032 - DNA, 1282 bp, synthetic construct
  misc_feature 1..1282: note = Synthetic polypeptide
  source 1..1282: mol_type = other DNA
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctga

SEQ ID NO: 15033 - DNA, 1477 bp, synthetic construct
  misc_feature 1..1477: note = Synthetic polypeptide
  source 1..1477: mol_type = other DNA
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactag

SEQ ID NO: 15034 - DNA, 1303 bp, synthetic construct
  misc_feature 1..1303: note = Synthetic polypeptide
  source 1..1303: mol_type = other DNA
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctga

SEQ ID NO: 15035 - DNA, 345 bp, synthetic construct
  misc_feature 1..345: note = Synthetic polypeptide
  source 1..345: mol_type = other DNA
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatga

SEQ ID NO: 15036 - DNA, 750 bp, synthetic construct
  misc_feature 1..750: note = Synthetic polypeptide
  source 1..750: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 15037 - DNA, 408 bp, synthetic construct
  misc_feature 1..408: note = Synthetic polypeptide
  source 1..408: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttggaaggcataaatgttggctga

SEQ ID NO: 15038 - DNA, 612 bp, synthetic construct
  misc_feature 1..612: note = Synthetic polypeptide
  source 1..612: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 15039 - DNA, 549 bp, synthetic construct
  misc_feature 1..549: note = Synthetic polypeptide
  source 1..549: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagaggcaaggtttgggataa

SEQ ID NO: 15040 - DNA, 663 bp, synthetic construct
  misc_feature 1..663: note = Synthetic polypeptide
  source 1..663: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 15041 - DNA, 616 bp, synthetic construct
  misc_feature 1..616: note = Synthetic polypeptide
  source 1..616: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaag

SEQ ID NO: 15042 - DNA, 570 bp, synthetic construct
  misc_feature 1..570: note = Synthetic polypeptide
  source 1..570: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatc

SEQ ID NO: 15043 - DNA, 533 bp, synthetic construct
  misc_feature 1..533: note = Synthetic polypeptide
  source 1..533: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagag

SEQ ID NO: 15044 - DNA, 337 bp, synthetic construct
  misc_feature 1..337: note = Synthetic polypeptide
  source 1..337: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgac

SEQ ID NO: 15045 - DNA, 276 bp, synthetic construct
  misc_feature 1..276: note = Synthetic polypeptide
  source 1..276: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgcc

SEQ ID NO: 15046 - DNA, 260 bp, synthetic construct
  misc_feature 1..260: note = Synthetic polypeptide
  source 1..260: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatga

SEQ ID NO: 15047 - DNA, 444 bp, synthetic construct
  misc_feature 1..444: note = Synthetic polypeptide
  source 1..444: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgttttgccttaaaaacttttggtggctccctgttgttattagaataaaagtgacacatctttacttggcattcatggccatgcacattctgacccaaccttcttactttttgtttttttaa

SEQ ID NO: 15048 - DNA, 325 bp, synthetic construct
  misc_feature 1..325: note = Synthetic polypeptide
  source 1..325: mol_type = other DNA
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgt

SEQ ID NO: 15049 - DNA, 666 bp, synthetic construct
  misc_feature 1..666: note = Synthetic polypeptide
  source 1..666: mol_type = other DNA
ggctggacgcggtggctcgtgcctgtaatcccagcagtttgggaggctgaggcgggcggatcacctgagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataa

SEQ ID NO: 15050 - DNA, 964 bp, synthetic construct
  misc_feature 1..964: note = Synthetic polypeptide
  source 1..964: mol_type = other DNA
agaggagcaagagattaagagaaaaagatatttgaagaggtaatgacagaattgtcaatctttgcaaagacacatttacaatttcacaaaattcagtgaaaacacaggatgaaataaaggaaaacatgcctagacacatcataatcatagtgctgaaaactaaaaataaggaaaatgtctcaaaaacagtgagagaagagtgatacattacatgcaagggactatgatttgaatgactgcaaatttctgatcagaaatcctggaggcaagtagatagtggagcaccttctttaagtgctgaaagaaaagaacttttaagccagaattctctatccagcaaaataatccttcaggaataaaagcaaaaaagagagacattctcagatggaggaaatgactggaattcatttccagcagacctgctctataagacatgttaatggaatttctgcaggatgaagcaaaatgatactacagagaaattagatctttagggatgaagaacagcagaaatggtaaatagtaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 15051 - DNA, 195 bp, synthetic construct
  misc_feature 1..195: note = Synthetic polypeptide
  source 1..195: mol_type = other DNA
tatcttgtgttgtttcagagagcagaactgggattcttggttcagggaggcagatttccagtgattgtaaggaagaatttgtaacagtggagtgcactgccttgcaaaataagatggggacttgcttggggtcttgctgcccaggctggtcttgaactcgtggcgtcaagggatcctcctgtctcagcctcctaa

SEQ ID NO: 15052 - DNA, 605 bp, synthetic construct; identical to SEQ ID NO: 8066
  misc_feature 1..605: note = Synthetic polypeptide
  source 1..605: mol_type = other DNA

SEQ ID NO: 15053 - DNA, 372 bp, synthetic construct; identical to SEQ ID NO: 8067
  misc_feature 1..372: note = Synthetic polypeptide
  source 1..372: mol_type = other DNA

SEQ ID NO: 15054 - DNA, 422 bp, synthetic construct; identical to SEQ ID NO: 8068
  misc_feature 1..422: note = Synthetic polypeptide
  source 1..422: mol_type = other DNA

SEQ ID NO: 15055 - DNA, 476 bp, synthetic construct; identical to SEQ ID NO: 8069
  misc_feature 1..476: note = Synthetic polypeptide
  source 1..476: mol_type = other DNA

SEQ ID NO: 15056 - DNA, 1807 bp, synthetic construct; identical to SEQ ID NO: 8089
  misc_feature 1..1807: note = Synthetic polypeptide
  source 1..1807: mol_type = other DNA

SEQ ID NO: 15057 - DNA, 404 bp, synthetic construct; identical to SEQ ID NO: 6813
  misc_feature 1..404: note = Synthetic polypeptide
  source 1..404: mol_type = other DNA

SEQ ID NO: 15058 - DNA, 417 bp, synthetic construct; identical to SEQ ID NO: 6814
  misc_feature 1..417: note = Synthetic polypeptide
  source 1..417: mol_type = other DNA

SEQ ID NO: 15059 - DNA, 485 bp, synthetic construct; identical to SEQ ID NO: 6815
  misc_feature 1..485: note = Synthetic polypeptide
  source 1..485: mol_type = other DNA

SEQ ID NO: 15060 - DNA, 1745 bp, synthetic construct; identical to SEQ ID NO: 6816
  misc_feature 1..1745: note = Synthetic polypeptide
  source 1..1745: mol_type = other DNA

SEQ ID NO: 15061 - DNA, 414 bp, synthetic construct; identical to SEQ ID NO: 6481
  misc_feature 1..414: note = Synthetic polypeptide
  source 1..414: mol_type = other DNA

SEQ ID NO: 15062 - DNA, 1325 bp, synthetic construct; identical to SEQ ID NO: 7686
  misc_feature 1..1325: note = Synthetic polypeptide
  source 1..1325: mol_type = other DNA

SEQ ID NO: 15063 - DNA, 1691 bp, synthetic construct; identical to SEQ ID NO: 7687
  misc_feature 1..1691: note = Synthetic polypeptide
  source 1..1691: mol_type = other DNA

SEQ ID NO: 15064 - DNA, 1541 bp, synthetic construct; identical to SEQ ID NO: 7688
  misc_feature 1..1541: note = Synthetic polypeptide
  source 1..1541: mol_type = other DNA

SEQ ID NO: 15065 - DNA, 374 bp, synthetic construct; identical to SEQ ID NO: 8117
  misc_feature 1..374: note = Synthetic polypeptide
  source 1..374: mol_type = other DNA

SEQ ID NO: 15066 - DNA, 3021 bp, synthetic construct; identical to SEQ ID NO: 449
  misc_feature 1..3021: note = Synthetic polypeptide
  source 1..3021: mol_type = other DNA

SEQ ID NO: 15067 - DNA, 3075 bp, synthetic construct; identical to SEQ ID NO: 450
  misc_feature 1..3075: note = Synthetic polypeptide
  source 1..3075: mol_type = other DNA

SEQ ID NO: 15068 - DNA, 1143 bp, synthetic construct; identical to SEQ ID NO: 451
  misc_feature 1..1143: note = Synthetic polypeptide
  source 1..1143: mol_type = other DNA

SEQ ID NO: 15069 - DNA, 1554 bp, synthetic construct; identical to SEQ ID NO: 8073
  misc_feature 1..1554: note = Synthetic polypeptide
  source 1..1554: mol_type = other DNA

SEQ ID NO: 15070 - DNA, 1154 bp, synthetic construct; identical to SEQ ID NO: 8078
  misc_feature 1..1154: note = Synthetic polypeptide
  source 1..1154: mol_type = other DNA

SEQ ID NO: 15071 - DNA, 163 bp, synthetic construct; identical to SEQ ID NO: 480
  misc_feature 1..163: note = Synthetic polypeptide
  source 1..163: mol_type = other DNA

SEQ ID NO: 15072 - DNA, 104 bp, synthetic construct; identical to SEQ ID NO: 481
  misc_feature 1..104: note = Synthetic polypeptide
  source 1..104: mol_type = other DNA

SEQ ID NO: 15073 - DNA, 1089 bp, synthetic construct; identical to SEQ ID NO: 8101
  misc_feature 1..1089: note = Synthetic polypeptide
  source 1..1089: mol_type = other DNA

SEQ ID NO: 15074 - DNA, 534 bp, synthetic construct; identical to SEQ ID NO: 8079
  misc_feature 1..534: note = Synthetic polypeptide
  source 1..534: mol_type = other DNA

SEQ ID NO: 15075 - DNA, 500 bp, synthetic construct; identical to SEQ ID NO: 8080
  misc_feature 1..500: note = Synthetic polypeptide
  source 1..500: mol_type = other DNA

SEQ ID NO: 15076 - DNA, 453 bp, synthetic construct; identical to SEQ ID NO: 8081
  misc_feature 1..453: note = Synthetic polypeptide
  source 1..453: mol_type = other DNA

SEQ ID NO: 15077 - DNA, 920 bp, synthetic construct; identical to SEQ ID NO: 8111
  misc_feature 1..920: note = Synthetic polypeptide
  source 1..920: mol_type = other DNA

SEQ ID NO: 15078 - DNA, 1227 bp, synthetic construct; identical to SEQ ID NO: 7622
  misc_feature 1..1227: note = Synthetic polypeptide
  source 1..1227: mol_type = other DNA

SEQ ID NO: 15079 - DNA, 1138 bp, synthetic construct; identical to SEQ ID NO: 7655
  misc_feature 1..1138: note = Synthetic polypeptide
  source 1..1138: mol_type = other DNA

SEQ ID NO: 15080 - DNA, 427 bp, synthetic construct; identical to SEQ ID NO: 573
  misc_feature 1..427: note = Synthetic polypeptide
  source 1..427: mol_type = other DNA

SEQ ID NO: 15081 - DNA, 1629 bp, synthetic construct; identical to SEQ ID NO: 8070
  misc_feature 1..1629: note = Synthetic polypeptide
  source 1..1629: mol_type = other DNA

SEQ ID NO: 15082 - DNA, 1500 bp, synthetic construct; identical to SEQ ID NO: 8071
  misc_feature 1..1500: note = Synthetic polypeptide
  source 1..1500: mol_type = other DNA

SEQ ID NO: 15083 - DNA, 186 bp, synthetic construct; identical to SEQ ID NO: 7638
  misc_feature 1..186: note = Synthetic polypeptide
  source 1..186: mol_type = other DNA

SEQ ID NO: 15084 - DNA, 5196 bp, synthetic construct; identical to SEQ ID NO: 8162
  misc_feature 1..5196: note = Synthetic polypeptide
  source 1..5196: mol_type = other DNA

SEQ ID NO: 15085 - DNA, 5277 bp, synthetic construct; identical to SEQ ID NO: 8163
  misc_feature 1..5277: note = Synthetic polypeptide
  source 1..5277: mol_type = other DNA

SEQ ID NO: 15086 - DNA, 3933 bp, synthetic construct; identical to SEQ ID NO: 8164
  misc_feature 1..3933: note = Synthetic polypeptide
  source 1..3933: mol_type = other DNA

SEQ ID NO: 15087 - DNA, 2010 bp, synthetic construct; identical to SEQ ID NO: 8165
  misc_feature 1..2010: note = Synthetic polypeptide
  source 1..2010: mol_type = other DNA

SEQ ID NO: 15088 - DNA, 404 bp, synthetic construct; identical to SEQ ID NO: 7701
  misc_feature 1..404: note = Synthetic polypeptide
  source 1..404: mol_type = other DNA

SEQ ID NO: 15089 - DNA, 336 bp, synthetic construct; identical to SEQ ID NO: 7702
  misc_feature 1..336: note = Synthetic polypeptide
  source 1..336: mol_type = other DNA

SEQ ID NO: 15090 - DNA, 3325 bp, synthetic construct; identical to SEQ ID NO: 7703
  misc_feature 1..3325: note = Synthetic polypeptide
  source 1..3325: mol_type = other DNA

SEQ ID NO: 15091 - DNA, 169 bp, synthetic construct; identical to SEQ ID NO: 7704
  misc_feature 1..169: note = Synthetic polypeptide
  source 1..169: mol_type = other DNA

SEQ ID NO: 15092 - DNA, 169 bp, synthetic construct; identical to SEQ ID NO: 7705
  misc_feature 1..169: note = Synthetic polypeptide
  source 1..169: mol_type = other DNA

SEQ ID NO: 15093 - DNA, 241 bp, synthetic construct; identical to SEQ ID NO: 7706
  misc_feature 1..241: note = Synthetic polypeptide
  source 1..241: mol_type = other DNA

SEQ ID NO: 15094 - DNA, 273 bp, synthetic construct; identical to SEQ ID NO: 7707
  misc_feature 1..273: note = Synthetic polypeptide
  source 1..273: mol_type = other DNA

SEQ ID NO: 15095 - DNA, 329 bp, synthetic construct; identical to SEQ ID NO: 7708
  misc_feature 1..329: note = Synthetic polypeptide
  source 1..329: mol_type = other DNA

SEQ ID NO: 15096 - DNA, 203 bp, synthetic construct; identical to SEQ ID NO: 7709
  misc_feature 1..203: note = Synthetic polypeptide
  source 1..203: mol_type = other DNA

SEQ ID NO: 15097 - DNA, 271 bp, synthetic construct; identical to SEQ ID NO: 7710
  misc_feature 1..271: note = Synthetic polypeptide
  source 1..271: mol_type = other DNA

SEQ ID NO: 15098 - DNA, 297 bp, synthetic construct; identical to SEQ ID NO: 7711
  misc_feature 1..297: note = Synthetic polypeptide
  source 1..297: mol_type = other DNA

SEQ ID NO: 15099 - DNA, 127 bp, synthetic construct; identical to SEQ ID NO: 7712
  misc_feature 1..127: note = Synthetic polypeptide
  source 1..127: mol_type = other DNA

SEQ ID NO: 15100 - DNA, 2254 bp, synthetic construct; identical to SEQ ID NO: 8053
  misc_feature 1..2254: note = Synthetic polypeptide
  source 1..2254: mol_type = other DNA

SEQ ID NO: 15101 - DNA, 2044 bp, synthetic construct; identical to SEQ ID NO: 8054
  misc_feature 1..2044: note = Synthetic polypeptide
  source 1..2044: mol_type = other DNA

SEQ ID NO: 15102 - DNA, 1735 bp, synthetic construct; identical to SEQ ID NO: 8055
  misc_feature 1..1735: note = Synthetic polypeptide
  source 1..1735: mol_type = other DNA

SEQ ID NO: 15103 - DNA, 1089 bp, synthetic construct; identical to SEQ ID NO: 8115
  misc_feature 1..1089: note = Synthetic polypeptide
  source 1..1089: mol_type = other DNA

SEQ ID NO: 15104 - DNA, 201 bp, synthetic construct; identical to SEQ ID NO: 6463
  misc_feature 1..201: note = Synthetic polypeptide
  source 1..201: mol_type = other DNA

SEQ ID NO: 15105 - DNA, 159 bp, synthetic construct; identical to SEQ ID NO: 6464
  misc_feature 1..159: note = Synthetic polypeptide
  source 1..159: mol_type = other DNA

SEQ ID NO: 15106 - DNA, 171 bp, synthetic construct; identical to SEQ ID NO: 6873
  misc_feature 1..171: note = Synthetic polypeptide
  source 1..171: mol_type = other DNA

SEQ ID NO: 15107 - DNA, 633 bp, synthetic construct; identical to SEQ ID NO: 6874
  misc_feature 1..633: note = Synthetic polypeptide
  source 1..633: mol_type = other DNA

SEQ ID NO: 15108 - DNA, 636 bp, synthetic construct; identical to SEQ ID NO: 6875
  misc_feature 1..636: note = Synthetic polypeptide
  source 1..636: mol_type = other DNA

SEQ ID NO: 15109 - DNA, 480 bp, synthetic construct; identical to SEQ ID NO: 6876
  misc_feature 1..480: note = Synthetic polypeptide
  source 1..480: mol_type = other DNA

SEQ ID NO: 15110 - DNA, 192 bp, synthetic construct; identical to SEQ ID NO: 8269
  misc_feature 1..192: note = Synthetic polypeptide
  source 1..192: mol_type = other DNA

SEQ ID NO: 15111 - DNA, 100 bp, synthetic construct; identical to SEQ ID NO: 8330
  misc_feature 1..100: note = Synthetic polypeptide
  source 1..100: mol_type = other DNA

SEQ ID NO: 15112 - DNA, 337 bp, synthetic construct; identical to SEQ ID NO: 6393
  misc_feature 1..337: note = Synthetic polypeptide
  source 1..337: mol_type = other DNA

SEQ ID NO: 15113 - DNA, 795 bp, synthetic construct; identical to SEQ ID NO: 8525
  misc_feature 1..795: note = Synthetic polypeptide
  source 1..795: mol_type = other DNA

SEQ ID NO: 15114 - DNA, 194 bp, synthetic construct; identical to SEQ ID NO: 8526
  misc_feature 1..194: note = Synthetic polypeptide
  source 1..194: mol_type = other DNA

SEQ ID NO: 15115 - DNA, 462 bp, synthetic construct; identical to SEQ ID NO: 8527
  misc_feature 1..462: note = Synthetic polypeptide
  source 1..462: mol_type = other DNA

SEQ ID NO: 15116 - DNA, 66 bp, synthetic construct; identical to SEQ ID NO: 8528
  misc_feature 1..66: note = Synthetic polypeptide
  source 1..66: mol_type = other DNA

SEQ ID NO: 15117 - DNA, 268 bp, synthetic construct; identical to SEQ ID NO: 8529
  misc_feature 1..268: note = Synthetic polypeptide
  source 1..268: mol_type = other DNA

SEQ ID NO: 15118 - DNA, 132 bp, synthetic construct; identical to SEQ ID NO: 8530
  misc_feature 1..132: note = Synthetic polypeptide
  source 1..132: mol_type = other DNA

SEQ ID NO: 15119 - DNA, 295 bp, synthetic construct; identical to SEQ ID NO: 8323
  misc_feature 1..295: note = Synthetic polypeptide
  source 1..295: mol_type = other DNA

SEQ ID NO: 15120 - DNA, 1117 bp, synthetic construct; identical to SEQ ID NO: 8324
  misc_feature 1..1117: note = Synthetic polypeptide
  source 1..1117: mol_type = other DNA

SEQ ID NO: 15121 - DNA, 931 bp, synthetic construct; identical to SEQ ID NO: 8325
  misc_feature 1..931: note = Synthetic polypeptide
  source 1..931: mol_type = other DNA

SEQ ID NO: 15122 - DNA, 873 bp, synthetic construct; identical to SEQ ID NO: 8120
  misc_feature 1..873: note = Synthetic polypeptide
  source 1..873: mol_type = other DNA

SEQ ID NO: 15123 - DNA, 921 bp, synthetic construct; identical to SEQ ID NO: 8121
  misc_feature 1..921: note = Synthetic polypeptide
  source 1..921: mol_type = other DNA

SEQ ID NO: 15124 - DNA, 507 bp, synthetic construct; identical to SEQ ID NO: 8229
  misc_feature 1..507: note = Synthetic polypeptide
  source 1..507: mol_type = other DNA

SEQ ID NO: 15125 - DNA, 1185 bp, synthetic construct; identical to SEQ ID NO: 8800
  misc_feature 1..1185: note = Synthetic polypeptide
  source 1..1185: mol_type = other DNA

SEQ ID NO: 15126 - DNA, 550 bp, synthetic construct; identical to SEQ ID NO: 8801
  misc_feature 1..550: note = Synthetic polypeptide
  source 1..550: mol_type = other DNA

SEQ ID NO: 15127 - DNA, 387 bp, synthetic construct; identical to SEQ ID NO: 8802
  misc_feature 1..387: note = Synthetic polypeptide
  source 1..387: mol_type = other DNA

SEQ ID NO: 15128 - DNA, 1713 bp, synthetic construct; identical to SEQ ID NO: 8803
  misc_feature 1..1713: note = Synthetic polypeptide
  source 1..1713: mol_type = other DNA

SEQ ID NO: 15129 - DNA, 1950 bp, synthetic construct; identical to SEQ ID NO: 8804
  misc_feature 1..1950: note = Synthetic polypeptide
  source 1..1950: mol_type = other DNA

SEQ ID NO: 15130 - DNA, 1005 bp, synthetic construct; identical to SEQ ID NO: 8447
  misc_feature 1..1005: note = Synthetic polypeptide
  source 1..1005: mol_type = other DNA

SEQ ID NO: 15131 - DNA, 942 bp, synthetic construct; identical to SEQ ID NO: 8448
  misc_feature 1..942: note = Synthetic polypeptide
  source 1..942: mol_type = other DNA

SEQ ID NO: 15132 - DNA, 559 bp, synthetic construct; identical to SEQ ID NO: 8449
  misc_feature 1..559: note = Synthetic polypeptide
  source 1..559: mol_type = other DNA

SEQ ID NO: 15133 - DNA, 2405 bp, synthetic construct; identical to SEQ ID NO: 8354
  misc_feature 1..2405: note = Synthetic polypeptide
  source 1..2405: mol_type = other DNA

SEQ ID NO: 15134 - DNA, 2252 bp, synthetic construct; identical to SEQ ID NO: 8355
  misc_feature 1..2252: note = Synthetic polypeptide
  source 1..2252: mol_type = other DNA

SEQ ID NO: 15135 - DNA, 2240 bp, synthetic construct; identical to SEQ ID NO: 8356
  misc_feature 1..2240: note = Synthetic polypeptide
  source 1..2240: mol_type = other DNA

SEQ ID NO: 15136 - DNA, 820 bp, synthetic construct; identical to SEQ ID NO: 7641
  misc_feature 1..820: note = Synthetic polypeptide
  source 1..820: mol_type = other DNA

SEQ ID NO: 15137 - DNA, 946 bp, synthetic construct; identical to SEQ ID NO: 7642
  misc_feature 1..946: note = Synthetic polypeptide
  source 1..946: mol_type = other DNA

SEQ ID NO: 15138 - DNA, 583 bp, synthetic construct; identical to SEQ ID NO: 7840
  misc_feature 1..583: note = Synthetic polypeptide
  source 1..583: mol_type = other DNA

SEQ ID NO: 15139 - DNA, 742 bp, synthetic construct; identical to SEQ ID NO: 6357
  misc_feature 1..742: note = Synthetic polypeptide
  source 1..742: mol_type = other DNA

SEQ ID NO: 15140 - DNA, 590 bp, synthetic construct; identical to SEQ ID NO: 6358
  misc_feature 1..590: note = Synthetic polypeptide
  source 1..590: mol_type = other DNA

SEQ ID NO: 15141 - DNA, 577 bp, synthetic construct; identical to SEQ ID NO: 6359
  misc_feature 1..577: note = Synthetic polypeptide
  source 1..577: mol_type = other DNA

SEQ ID NO: 15142 - DNA, 430 bp, synthetic construct; identical to SEQ ID NO: 6360
  misc_feature 1..430: note = Synthetic polypeptide
  source 1..430: mol_type = other DNA

SEQ ID NO: 15143 - DNA, 670 bp, synthetic construct; identical to SEQ ID NO: 6361
  misc_feature 1..670: note = Synthetic polypeptide
  source 1..670: mol_type = other DNA

SEQ ID NO: 15144 - DNA, 366 bp, synthetic construct; identical to SEQ ID NO: 7663
  misc_feature 1..366: note = Synthetic polypeptide
  source 1..366: mol_type = other DNA

SEQ ID NO: 15145 - DNA, 543 bp, synthetic construct; identical to SEQ ID NO: 6496
  misc_feature 1..543: note = Synthetic polypeptide
  source 1..543: mol_type = other DNA

SEQ ID NO: 15146 - DNA, 378 bp, synthetic construct; identical to SEQ ID NO: 6497
  misc_feature 1..378: note = Synthetic polypeptide
  source 1..378: mol_type = other DNA

SEQ ID NO: 15147 - DNA, 267 bp, synthetic construct; identical to SEQ ID NO: 6498
  misc_feature 1..267: note = Synthetic polypeptide
  source 1..267: mol_type = other DNA

SEQ ID NO: 15148 - DNA, 416 bp, synthetic construct; identical to SEQ ID NO: 6499
  misc_feature 1..416: note = Synthetic polypeptide
  source 1..416: mol_type = other DNA

SEQ ID NO: 15149 - DNA, 162 bp, synthetic construct; identical to SEQ ID NO: 6500
  misc_feature 1..162: note = Synthetic polypeptide
  source 1..162: mol_type = other DNA

SEQ ID NO: 15150 - DNA, 336 bp, synthetic construct; identical to SEQ ID NO: 7520
  misc_feature 1..336: note = Synthetic polypeptide
  source 1..336: mol_type = other DNA

SEQ ID NO: 15151 - DNA, 346 bp, synthetic construct; identical to SEQ ID NO: 7521
  misc_feature 1..346: note = Synthetic polypeptide
  source 1..346: mol_type = other DNA

SEQ ID NO: 15152 - DNA, 272 bp, synthetic construct; identical to SEQ ID NO: 8166
  misc_feature 1..272: note = Synthetic polypeptide
  source 1..272: mol_type = other DNA

SEQ ID NO: 15153 - DNA, 89 bp, synthetic construct; identical to SEQ ID NO: 8167
  misc_feature 1..89: note = Synthetic polypeptide
  source 1..89: mol_type = other DNA

SEQ ID NO: 15154 - DNA, 223 bp, synthetic construct; identical to SEQ ID NO: 8168
  misc_feature 1..223: note = Synthetic polypeptide
  source 1..223: mol_type = other DNA

SEQ ID NO: 15155 - DNA, 207 bp, synthetic construct; identical to SEQ ID NO: 7693
  misc_feature 1..207: note = Synthetic polypeptide
  source 1..207: mol_type = other DNA

SEQ ID NO: 15156 - DNA, 268 bp, synthetic construct; identical to SEQ ID NO: 7694
  misc_feature 1..268: note = Synthetic polypeptide
  source 1..268: mol_type = other DNA

SEQ ID NO: 15157 - DNA, 483 bp, synthetic construct; identical to SEQ ID NO: 7323
  misc_feature 1..483: note = Synthetic polypeptide
  source 1..483: mol_type = other DNA

SEQ ID NO: 15158 - DNA, 252 bp, synthetic construct; identical to SEQ ID NO: 8153
  misc_feature 1..252: note = Synthetic polypeptide
  source 1..252: mol_type = other DNA

SEQ ID NO: 15159 - DNA, 1216 bp, synthetic construct; identical to SEQ ID NO: 6819
  misc_feature 1..1216: note = Synthetic polypeptide
  source 1..1216: mol_type = other DNA

SEQ ID NO: 15160 - DNA, 510 bp, synthetic construct; identical to SEQ ID NO: 6820
  misc_feature 1..510: note = Synthetic polypeptide
  source 1..510: mol_type = other DNA

SEQ ID NO: 15161 - DNA, 1086 bp, synthetic construct; identical to SEQ ID NO: 6423
  misc_feature 1..1086: note = Synthetic polypeptide
  source 1..1086: mol_type = other DNA

SEQ ID NO: 15162 - DNA, 139 bp, synthetic construct; identical to SEQ ID NO: 8939
  misc_feature 1..139: note = Synthetic polypeptide
  source 1..139: mol_type = other DNA

SEQ ID NO: 15163 - DNA, 368 bp, synthetic construct; identical to SEQ ID NO: 8940
  misc_feature 1..368: note = Synthetic polypeptide
  source 1..368: mol_type = other DNA

SEQ ID NO: 15164 - DNA, 2192 bp, synthetic construct; identical to SEQ ID NO: 8941
  misc_feature 1..2192: note = Synthetic polypeptide
  source 1..2192: mol_type = other DNA

SEQ ID NO: 15165 - DNA, 1328 bp, synthetic construct; identical to SEQ ID NO: 8942
  misc_feature 1..1328: note = Synthetic polypeptide
  source 1..1328: mol_type = other DNA

SEQ ID NO: 15166 - DNA, 2117 bp, synthetic construct; identical to SEQ ID NO: 8943
  misc_feature 1..2117: note = Synthetic polypeptide
  source 1..2117: mol_type = other DNA

SEQ ID NO: 15167 - DNA, 1265 bp, synthetic construct; identical to SEQ ID NO: 8944
  misc_feature 1..1265: note = Synthetic polypeptide
  source 1..1265: mol_type = other DNA

SEQ ID NO: 15168 - DNA, 1331 bp, synthetic construct; identical to SEQ ID NO: 8945
  misc_feature 1..1331: note = Synthetic polypeptide
  source 1..1331: mol_type = other DNA

SEQ ID NO: 15169 - DNA, 320 bp, synthetic construct; identical to SEQ ID NO: 8218
  misc_feature 1..320: note = Synthetic polypeptide
  source 1..320: mol_type = other DNA

SEQ ID NO: 15170 - DNA, 485 bp, synthetic construct; identical to SEQ ID NO: 8219
  misc_feature 1..485: note = Synthetic polypeptide
  source 1..485: mol_type = other DNA

SEQ ID NO: 15171 - DNA, 326 bp, synthetic construct; identical to SEQ ID NO: 6484
  misc_feature 1..326: note = Synthetic polypeptide
  source 1..326: mol_type = other DNA

SEQ ID NO: 15172 - DNA, 146 bp, synthetic construct; identical to SEQ ID NO: 6485
  misc_feature 1..146: note = Synthetic polypeptide
  source 1..146: mol_type = other DNA

SEQ ID NO: 15173 - DNA, 3238 bp, synthetic construct; identical to SEQ ID NO: 8118
  misc_feature 1..3238: note = Synthetic polypeptide
  source 1..3238: mol_type = other DNA

SEQ ID NO: 15174 - DNA, 4233 bp, synthetic construct; identical to SEQ ID NO: 8337
  misc_feature 1..4233: note = Synthetic polypeptide
  source 1..4233: mol_type = other DNA

SEQ ID NO: 15175 - DNA, 2022 bp, synthetic construct; identical to SEQ ID NO: 8338
  misc_feature 1..2022: note = Synthetic polypeptide
  source 1..2022: mol_type = other DNA

SEQ ID NO: 15176 - DNA, 636 bp, synthetic construct; identical to SEQ ID NO: 8339
  misc_feature 1..636: note = Synthetic polypeptide
  source 1..636: mol_type = other DNA

SEQ ID NO: 15177 - DNA, 1746 bp, synthetic construct; identical to SEQ ID NO: 8226
  misc_feature 1..1746: note = Synthetic polypeptide
  source 1..1746: mol_type = other DNA

SEQ ID NO: 15178 - DNA, 1749 bp, synthetic construct; identical to SEQ ID NO: 8227
  misc_feature 1..1749: note = Synthetic polypeptide
  source 1..1749: mol_type = other DNA

SEQ ID NO: 15179 - DNA, 519 bp, synthetic construct; identical to SEQ ID NO: 8228
  misc_feature 1..519: note = Synthetic polypeptide
  source 1..519: mol_type = other DNA

SEQ ID NO: 15180 - DNA, 3609 bp, synthetic construct; identical to SEQ ID NO: 11178
  misc_feature 1..3609: note = Synthetic polypeptide
  source 1..3609: mol_type = other DNA

SEQ ID NO: 15181 - DNA, 283 bp, synthetic construct; identical to SEQ ID NO: 11179
  misc_feature 1..283: note = Synthetic polypeptide
  source 1..283: mol_type = other DNA

SEQ ID NO: 15182 - DNA, 1461 bp, synthetic construct; identical to SEQ ID NO: 7696
  misc_feature 1..1461: note = Synthetic polypeptide
  source 1..1461: mol_type = other DNA

SEQ ID NO: 15183 - DNA, 2582 bp, synthetic construct; identical to SEQ ID NO: 12600
  misc_feature 1..2582: note = Synthetic polypeptide
  source 1..2582: mol_type = other DNA

SEQ ID NO: 15184 - DNA, 353 bp, synthetic construct; identical to SEQ ID NO: 12601
  misc_feature 1..353: note = Synthetic polypeptide
  source 1..353: mol_type = other DNA

SEQ ID NO: 15185 - DNA, 142 bp, synthetic construct; identical to SEQ ID NO: 12602
  misc_feature 1..142: note = Synthetic polypeptide
  source 1..142: mol_type = other DNA

SEQ ID NO: 15186 - DNA, 66 bp, synthetic construct; identical to SEQ ID NO: 12603
  misc_feature 1..66: note = Synthetic polypeptide
  source 1..66: mol_type = other DNA

SEQ ID NO: 15187 - DNA, 1224 bp, synthetic construct; identical to SEQ ID NO: 6690
  misc_feature 1..1224: note = Synthetic polypeptide
  source 1..1224: mol_type = other DNA

SEQ ID NO: 15188 - DNA, 355 bp, synthetic construct; identical to SEQ ID NO: 8468
  misc_feature 1..355: note = Synthetic polypeptide
  source 1..355: mol_type = other DNA

SEQ ID NO: 15189 - DNA, 192 bp, synthetic construct; identical to SEQ ID NO: 12734
  misc_feature 1..192: note = Synthetic polypeptide
  source 1..192: mol_type = other DNA

SEQ ID NO: 15190 - DNA, 1965 bp, synthetic construct; identical to SEQ ID NO: 8289
  misc_feature 1..1965: note = Synthetic polypeptide
  source 1..1965: mol_type = other DNA

SEQ ID NO: 15191 - DNA, 853 bp, synthetic construct; identical to SEQ ID NO: 8074
  misc_feature 1..853: note = Synthetic polypeptide
  source 1..853: mol_type = other DNA

SEQ ID NO: 15192 - DNA, 353 bp, synthetic construct; identical to SEQ ID NO: 8295
  misc_feature 1..353: note = Synthetic polypeptide
  source 1..353: mol_type = other DNA

SEQ ID NO: 15193 - DNA, 483 bp, synthetic construct; identical to SEQ ID NO: 7330
  misc_feature 1..483: note = Synthetic polypeptide
  source 1..483: mol_type = other DNA

SEQ ID NO: 15194 - DNA, 163 bp, synthetic construct; identical to SEQ ID NO: 8321
  misc_feature 1..163: note = Synthetic polypeptide
  source 1..163: mol_type = other DNA

SEQ ID NO: 15195 - DNA, 681 bp, synthetic construct; identical to SEQ ID NO: 8322
  misc_feature 1..681: note = Synthetic polypeptide
  source 1..681: mol_type = other DNA

SEQ ID NO: 15196 - DNA, 340 bp, synthetic construct; identical to SEQ ID NO: 8193
  misc_feature 1..340: note = Synthetic polypeptide
  source 1..340: mol_type = other DNA

SEQ ID NO: 15197 - DNA, 2147 bp, synthetic construct; identical to SEQ ID NO: 8253
  misc_feature 1..2147: note = Synthetic polypeptide
  source 1..2147: mol_type = other DNA

SEQ ID NO: 15198 - DNA, 643 bp, synthetic construct; identical to SEQ ID NO: 8156
  misc_feature 1..643: note = Synthetic polypeptide
  source 1..643: mol_type = other DNA

SEQ ID NO: 15199 - DNA, 589 bp, synthetic construct; identical to SEQ ID NO: 8157
  misc_feature 1..589: note = Synthetic polypeptide
  source 1..589: mol_type = other DNA

SEQ ID NO: 15200 - DNA, 301 bp, synthetic construct; identical to SEQ ID NO: 8158
  misc_feature 1..301: note = Synthetic polypeptide
  source 1..301: mol_type = other DNA

SEQ ID NO: 15201 - DNA, 2729 bp, synthetic construct
  misc_feature 1..2729: note = Synthetic polypeptide
  source 1..2729: mol_type = other DNA
gccaggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctag

SEQ ID NO: 15202 - DNA, 558 bp, synthetic construct; identical to SEQ ID NO: 8182
  misc_feature 1..558: note = Synthetic polypeptide
  source 1..558: mol_type = other DNA

SEQ ID NO: 15203 - DNA, 1793 bp, synthetic construct; identical to SEQ ID NO: 8183
  misc_feature 1..1793: note = Synthetic polypeptide
  source 1..1793: mol_type = other DNA

SEQ ID NO: 15204 - DNA, 1931 bp, synthetic construct; identical to SEQ ID NO: 8184
  misc_feature 1..1931: note = Synthetic polypeptide
  source 1..1931: mol_type = other DNA

SEQ ID NO: 15205 - DNA, 227 bp, synthetic construct
  misc_feature 1..227: note = Synthetic polypeptide
  source 1..227: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcaggg

SEQ ID NO: 15206 - DNA, 1622 bp, synthetic construct
  misc_feature 1..1622: note = Synthetic polypeptide
  source 1..1622: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 15207 - DNA, 291 bp, synthetic construct
  misc_feature 1..291: note = Synthetic polypeptide
  source 1..291: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagct

SEQ ID NO: 15208 - DNA, 1415 bp, synthetic construct
  misc_feature 1..1415: note = Synthetic polypeptide
  source 1..1415: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 15209 - DNA, 364 bp, synthetic construct
  misc_feature 1..364: note = Synthetic polypeptide
  source 1..364: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaacc

SEQ ID NO: 15210 - DNA, 509 bp, synthetic construct
  misc_feature 1..509: note = Synthetic polypeptide
  source 1..509: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagc

SEQ ID NO: 15211 - DNA, 526 bp, synthetic construct
  misc_feature 1..526: note = Synthetic polypeptide
  source 1..526: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactg

SEQ ID NO: 15212 - DNA, 742 bp, synthetic construct
  misc_feature 1..742: note = Synthetic polypeptide
  source 1..742: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 15213 - DNA, 408 bp, synthetic construct
  misc_feature 1..408: note = Synthetic polypeptide
  source 1..408: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgc

SEQ ID NO: 15214 - DNA, 466 bp, synthetic construct
  misc_feature 1..466: note = Synthetic polypeptide
  source 1..466: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaa

SEQ ID NO: 15215 - DNA, 674 bp, synthetic construct
  misc_feature 1..674: note = Synthetic polypeptide
  source 1..674: mol_type = other DNA
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggcc

SEQ ID NO: 15216 - DNA, 289 bp, synthetic construct; identical to SEQ ID NO: 7343
  misc_feature 1..289: note = Synthetic polypeptide
  source 1..289: mol_type = other DNA

SEQ ID NO: 15217 - DNA, 246 bp, synthetic construct; identical to SEQ ID NO: 7344
  misc_feature 1..246: note = Synthetic polypeptide
  source 1..246: mol_type = other DNA

SEQ ID NO: 15218 - DNA, 149 bp, synthetic construct; identical to SEQ ID NO: 7345
  misc_feature 1..149: note = Synthetic polypeptide
  source 1..149: mol_type = other DNA

SEQ ID NO: 15219 - DNA, 89 bp, synthetic construct; identical to SEQ ID NO: 7346
  misc_feature 1..89: note = Synthetic polypeptide
  source 1..89: mol_type = other DNA

SEQ ID NO: 15220 - DNA, 80 bp, synthetic construct; identical to SEQ ID NO: 7347
  misc_feature 1..80: note = Synthetic polypeptide
  source 1..80: mol_type = other DNA

SEQ ID NO: 15221 - DNA, 527 bp, synthetic construct; identical to SEQ ID NO: 7665
  misc_feature 1..527: note = Synthetic polypeptide
  source 1..527: mol_type = other DNA

SEQ ID NO: 15222 - DNA, 2983 bp, synthetic construct; identical to SEQ ID NO: 8169
  misc_feature 1..2983: note = Synthetic polypeptide
  source 1..2983: mol_type = other DNA

SEQ ID NO: 15223 - DNA, 3010 bp, synthetic construct; identical to SEQ ID NO: 8170
  misc_feature 1..3010: note = Synthetic polypeptide
  source 1..3010: mol_type = other DNA

SEQ ID NO: 15224 - DNA, 333 bp, synthetic construct; identical to SEQ ID NO: 6583
  misc_feature 1..333: note = Synthetic polypeptide
  source 1..333: mol_type = other DNA

SEQ ID NO: 15225 - DNA, 1775 bp, synthetic construct; identical to SEQ ID NO: 568
  misc_feature 1..1775: note = Synthetic polypeptide
  source 1..1775: mol_type = other DNA

SEQ ID NO: 15226 - DNA, 1477 bp, synthetic construct; identical to SEQ ID NO: 509
  misc_feature 1..1477: note = Synthetic polypeptide
  source 1..1477: mol_type = other DNA

SEQ ID NO: 15227 - DNA, 1369 bp, synthetic construct; identical to SEQ ID NO: 510
  misc_feature 1..1369: note = Synthetic polypeptide
  source 1..1369: mol_type = other DNA

SEQ ID NO: 15228 - DNA, 709 bp, synthetic construct; identical to SEQ ID NO: 511
  misc_feature 1..709: note = Synthetic polypeptide
  source 1..709: mol_type = other DNA

SEQ ID NO: 15229 - DNA, 303 bp, synthetic construct; identical to SEQ ID NO: 6723
  misc_feature 1..303: note = Synthetic polypeptide
  source 1..303: mol_type = other DNA

SEQ ID NO: 15230 - DNA, 189 bp, synthetic construct; identical to SEQ ID NO: 6724
  misc_feature 1..189: note = Synthetic polypeptide
  source 1..189: mol_type = other DNA

SEQ ID NO: 15231 - DNA, 318 bp, synthetic construct; identical to SEQ ID NO: 6725
  misc_feature 1..318: note = Synthetic polypeptide
  source 1..318: mol_type = other DNA

SEQ ID NO: 15232 - DNA, 138 bp, synthetic construct; identical to SEQ ID NO: 6726
  misc_feature 1..138: note = Synthetic polypeptide
  source 1..138: mol_type = other DNA

SEQ ID NO: 15233 - DNA, 1306 bp, synthetic construct; identical to SEQ ID NO: 8428
  misc_feature 1..1306: note = Synthetic polypeptide
  source 1..1306: mol_type = other DNA

SEQ ID NO: 15234 - DNA, 641 bp, synthetic construct; identical to SEQ ID NO: 8429
  misc_feature 1..641: note = Synthetic polypeptide
  source 1..641: mol_type = other DNA

SEQ ID NO: 15235 - DNA, 1207 bp, synthetic construct; identical to SEQ ID NO: 8430
  misc_feature 1..1207: note = Synthetic polypeptide
  source 1..1207: mol_type = other DNA

SEQ ID NO: 15236 - DNA, 1402 bp, synthetic construct; identical to SEQ ID NO: 8431
  misc_feature 1..1402: note = Synthetic polypeptide
  source 1..1402: mol_type = other DNA

SEQ ID NO: 15237 - DNA, 2850 bp, synthetic construct; identical to SEQ ID NO: 512
  misc_feature 1..2850: note = Synthetic polypeptide
  source 1..2850: mol_type = other DNA

SEQ ID NO: 15238 - DNA, 477 bp, synthetic construct; identical to SEQ ID NO: 513
  misc_feature 1..477: note = Synthetic polypeptide
  source 1..477: mol_type = other DNA

SEQ ID NO: 15239 - DNA, 4686 bp, synthetic construct; identical to SEQ ID NO: 8201
  misc_feature 1..4686: note = Synthetic polypeptide
  source 1..4686: mol_type = other DNA

SEQ ID NO: 15240 - DNA, 6266 bp, synthetic construct; identical to SEQ ID NO: 8202
  misc_feature 1..6266: note = Synthetic polypeptide
  source 1..6266: mol_type = other DNA

SEQ ID NO: 15241 - DNA, 5837 bp, synthetic construct; identical to SEQ ID NO: 8203
  misc_feature 1..5837: note = Synthetic polypeptide
  source 1..5837: mol_type = other DNA

SEQ ID NO: 15242 - DNA, 3243 bp, synthetic construct; identical to SEQ ID NO: 12893
  misc_feature 1..3243: note = Synthetic polypeptide
  source 1..3243: mol_type = other DNA

SEQ ID NO: 15243 - DNA, 878 bp, synthetic construct; identical to SEQ ID NO: 12894
  misc_feature 1..878: note = Synthetic polypeptide
  source 1..878: mol_type = other DNA

SEQ ID NO: 15244 - DNA, 545 bp, synthetic construct; identical to SEQ ID NO: 12895
  misc_feature 1..545: note = Synthetic polypeptide
  source 1..545: mol_type = other DNA

SEQ ID NO: 15245 - DNA, 877 bp, synthetic construct; identical to SEQ ID NO: 12896
  misc_feature 1..877: note = Synthetic polypeptide
  source 1..877: mol_type = other DNA

SEQ ID NO: 15246 - DNA, 498 bp, synthetic construct; identical to SEQ ID NO: 12897
  misc_feature 1..498: note = Synthetic polypeptide
  source 1..498: mol_type = other DNA

SEQ ID NO: 15247 - DNA, 615 bp, synthetic construct; identical to SEQ ID NO: 12898
  misc_feature 1..615: note = Synthetic polypeptide
  source 1..615: mol_type = other DNA

SEQ ID NO: 15248 - DNA, 701 bp, synthetic construct; identical to SEQ ID NO: 658
  misc_feature 1..701: note = Synthetic polypeptide
  source 1..701: mol_type = other DNA

SEQ ID NO: 15249 - DNA, 685 bp, synthetic construct
  misc_feature 1..685: note = Synthetic polypeptide
  source 1..685: mol_type = other DNA
agcctggattgcagaatcaagaggccaggcttctactaacatctctgtgaaagtccagctagtatgacctgagatatattctttgtggtgcctgggcctcagtttctctactggtaaaatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaa

SEQ ID NO: 15250 - DNA, 298 bp, synthetic construct; identical to SEQ ID NO: 13442
  misc_feature 1..298: note = Synthetic polypeptide
  source 1..298: mol_type = other DNA

SEQ ID NO: 15251 - DNA, 531 bp, synthetic construct
  misc_feature 1..531: note = Synthetic polypeptide
  source 1..531: mol_type = other DNA
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 15252 - DNA, 1872 bp, synthetic construct
  misc_feature 1..1872: note = Synthetic polypeptide
  source 1..1872: mol_type = other DNA
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 15253 - DNA, 544 bp, synthetic construct
  misc_feature 1..544: note = Synthetic polypeptide
  source 1..544: mol_type = other DNA
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 15254 - DNA, 612 bp, synthetic construct
  misc_feature 1..612: note = Synthetic polypeptide
  source 1..612: mol_type = other DNA
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 15255 - DNA, 1473 bp, synthetic construct; identical to SEQ ID NO: 12916
  misc_feature 1..1473: note = Synthetic polypeptide
  source 1..1473: mol_type = other DNA

SEQ ID NO: 15256 - DNA, 1446 bp, synthetic construct; identical to SEQ ID NO: 12917
  misc_feature 1..1446: note = Synthetic polypeptide
  source 1..1446: mol_type = other DNA

SEQ ID NO: 15257 - DNA, 1181 bp, synthetic construct; identical to SEQ ID NO: 12918
  misc_feature 1..1181: note = Synthetic polypeptide
  source 1..1181: mol_type = other DNA

SEQ ID NO: 15258 - DNA, 921 bp, synthetic construct; identical to SEQ ID NO: 12919
  misc_feature 1..921: note = Synthetic polypeptide
  source 1..921: mol_type = other DNA

SEQ ID NO: 15259 - DNA, 360 bp, synthetic construct; identical to SEQ ID NO: 12920
  misc_feature 1..360: note = Synthetic polypeptide
  source 1..360: mol_type = other DNA

SEQ ID NO: 15260 - DNA, 366 bp, synthetic construct; identical to SEQ ID NO: 12921
  misc_feature 1..366: note = Synthetic polypeptide
  source 1..366: mol_type = other DNA

SEQ ID NO: 15261 - DNA, 715 bp, synthetic construct; identical to SEQ ID NO: 12922
  misc_feature 1..715: note = Synthetic polypeptide
  source 1..715: mol_type = other DNA

SEQ ID NO: 15262 - DNA, 671 bp, synthetic construct; identical to SEQ ID NO: 12923
  misc_feature 1..671: note = Synthetic polypeptide
  source 1..671: mol_type = other DNA

SEQ ID NO: 15263 - DNA, 363 bp, synthetic construct; identical to SEQ ID NO: 12924
  misc_feature 1..363: note = Synthetic polypeptide
  source 1..363: mol_type = other DNA

SEQ ID NO: 15264 - DNA, 339 bp, synthetic construct; identical to SEQ ID NO: 12925
  misc_feature 1..339: note = Synthetic polypeptide
  source 1..339: mol_type = other DNA

SEQ ID NO: 15265 - DNA, 354 bp, synthetic construct; identical to SEQ ID NO: 12926
  misc_feature 1..354: note = Synthetic polypeptide
  source 1..354: mol_type = other DNA

SEQ ID NO: 15266 - DNA, 494 bp, synthetic construct; identical to SEQ ID NO: 12927
  misc_feature 1..494: note = Synthetic polypeptide
  source 1..494: mol_type = other DNA

SEQ ID NO: 15267 - DNA, 488 bp, synthetic construct; identical to SEQ ID NO: 12928
  misc_feature 1..488: note = Synthetic polypeptide
  source 1..488: mol_type = other DNA

SEQ ID NO: 15268 - DNA, 472 bp, synthetic construct; identical to SEQ ID NO: 12929
  misc_feature 1..472: note = Synthetic polypeptide
  source 1..472: mol_type = other DNA

SEQ ID NO: 15269 - DNA, 363 bp, synthetic construct; identical to SEQ ID NO: 12930
  misc_feature 1..363: note = Synthetic polypeptide
  source 1..363: mol_type = other DNA

SEQ ID NO: 15270 - DNA, 3621 bp, synthetic construct; identical to SEQ ID NO: 8171
  misc_feature 1..3621: note = Synthetic polypeptide
  source 1..3621: mol_type = other DNA

SEQ ID NO: 15271 - DNA, 3312 bp, synthetic construct; identical to SEQ ID NO: 8172
  misc_feature 1..3312: note = Synthetic polypeptide
  source 1..3312: mol_type = other DNA

SEQ ID NO: 15272 - DNA, 2928 bp, synthetic construct; identical to SEQ ID NO: 8173
  misc_feature 1..2928: note = Synthetic polypeptide
  source 1..2928: mol_type = other DNA

SEQ ID NO: 15273 - DNA, 3435 bp, synthetic construct; identical to SEQ ID NO: 8174
  misc_feature 1..3435: note = Synthetic polypeptide
  source 1..3435: mol_type = other DNA

SEQ ID NO: 15274 - DNA, 4198 bp, synthetic construct
  misc_feature 1..4198: note = Synthetic polypeptide
  source 1..4198: mol_type = other DNA
gcgtcatggataagcagacgggctatggagtttgaacccaggttgtctgggtccaaaacctggcccagccacttgctagctgtgtgacctaatccctctgcacctcaacctcctcatctataaaaacaaagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaa

SEQ ID NO: 15275 - DNA, 658 bp, synthetic construct; identical to SEQ ID NO: 7189
  misc_feature 1..658: note = Synthetic polypeptide
  source 1..658: mol_type = other DNA

SEQ ID NO: 15276 - DNA, 1999 bp, synthetic construct; identical to SEQ ID NO: 7190
  misc_feature 1..1999: note = Synthetic polypeptide
  source 1..1999: mol_type = other DNA

SEQ ID NO: 15277 - DNA, 671 bp, synthetic construct; identical to SEQ ID NO: 7191
  misc_feature 1..671: note = Synthetic polypeptide
  source 1..671: mol_type = other DNA

SEQ ID NO: 15278 - DNA, 739 bp, synthetic construct; identical to SEQ ID NO: 7192
  misc_feature 1..739: note = Synthetic polypeptide
  source 1..739: mol_type = other DNA

SEQ ID NO: 15279 - DNA, 352 bp, synthetic construct; identical to SEQ ID NO: 8547
  misc_feature 1..352: note = Synthetic polypeptide
  source 1..352: mol_type = other DNA

SEQ ID NO: 15280 - DNA, 274 bp, synthetic construct; identical to SEQ ID NO: 8548
  misc_feature 1..274: note = Synthetic polypeptide
  source 1..274: mol_type = other DNA

SEQ ID NO: 15281 - DNA, 246 bp, synthetic construct; identical to SEQ ID NO: 8549
  misc_feature 1..246: note = Synthetic polypeptide
  source 1..246: mol_type = other DNA

SEQ ID NO: 15282 - DNA, 423 bp, synthetic construct; identical to SEQ ID NO: 6550
  misc_feature 1..423: note = Synthetic polypeptide
  source 1..423: mol_type = other DNA

SEQ ID NO: 15283 - DNA, 950 bp, synthetic construct; identical to SEQ ID NO: 8419
  misc_feature 1..950: note = Synthetic polypeptide
  source 1..950: mol_type = other DNA

SEQ ID NO: 15284 - DNA, 1562 bp, synthetic construct
  misc_feature 1..1562: note = Synthetic polypeptide
  source 1..1562: mol_type = other DNA
tgacatgatttgcctctgtgtccccacccaaatctcatgatgaattgtaatccccacatgtcaggggagggacctggtgggaagtgattggatcatgggggaggatttccccctttctgttcttgtgatagtgagttatcacgagatctgatggtttaaaagtgtggcactttcccctttgcgctctttctttctctcctgccaccttgtgaagaaggtgcttgcttctcctttgccttctgccatgattttaagtttcccgaggcctccccagccatgtggaactatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 15285 - DNA, 1376 bp, synthetic construct
  misc_feature 1..1376: note = Synthetic polypeptide
  source 1..1376: mol_type = other DNA
tgacatgatttgcctctgtgtccccacccaaatctcatgatgaattgtaatccccacatgtcaggggagggacctggtgggaagtgattggatcatgggggaggatttccccctttctgttcttgtgatagtgagttatcacgagatctgatggtttaaaagtgtggcactttcccctttgcgctctttctttctctcctgccaccttgtgaagaaggtgcttgcttctcctttgccttctgccatgattttaagtttcccgaggcctccccagccatgtggaactatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 15286 - DNA, 2662 bp, synthetic construct; identical to SEQ ID NO: 8473
  misc_feature 1..2662: note = Synthetic polypeptide
  source 1..2662: mol_type = other DNA

SEQ ID NO: 15287 - DNA, 1822 bp, synthetic construct; identical to SEQ ID NO: 8474
  misc_feature 1..1822: note = Synthetic polypeptide
  source 1..1822: mol_type = other DNA

SEQ ID NO: 15288 - DNA, 1461 bp, synthetic construct; identical to SEQ ID NO: 14755
  misc_feature 1..1461: note = Synthetic polypeptide
  source 1..1461: mol_type = other DNA

SEQ ID NO: 15289 - DNA, 2502 bp, synthetic construct; identical to SEQ ID NO: 13060
  misc_feature 1..2502: note = Synthetic polypeptide
  source 1..2502: mol_type = other DNA

SEQ ID NO: 15290 - DNA, 390 bp, synthetic construct; identical to SEQ ID NO: 13061
  misc_feature 1..390: note = Synthetic polypeptide
  source 1..390: mol_type = other DNA

SEQ ID NO: 15291 - DNA, 771 bp, synthetic construct; identical to SEQ ID NO: 13062
  misc_feature 1..771: note = Synthetic polypeptide
  source 1..771: mol_type = other DNA

SEQ ID NO: 15292 - DNA, 682 bp, synthetic construct; identical to SEQ ID NO: 9078
  misc_feature 1..682: note = Synthetic polypeptide
  source 1..682: mol_type = other DNA

SEQ ID NO: 15293 - DNA, 78 bp, synthetic construct; identical to SEQ ID NO: 9079
  misc_feature 1..78: note = Synthetic polypeptide
  source 1..78: mol_type = other DNA

SEQ ID NO: 15294 - DNA, 481 bp, synthetic construct; identical to SEQ ID NO: 9080
  misc_feature 1..481: note = Synthetic polypeptide
  source 1..481: mol_type = other DNA

SEQ ID NO: 15295 - DNA, 292 bp, synthetic construct; identical to SEQ ID NO: 9081
  misc_feature 1..292: note = Synthetic polypeptide
  source 1..292: mol_type = other DNA

SEQ ID NO: 15296 - DNA, 236 bp, synthetic construct; identical to SEQ ID NO: 9082
  misc_feature 1..236: note = Synthetic polypeptide
  source 1..236: mol_type = other DNA

SEQ ID NO: 15297 - DNA, 682 bp, synthetic construct; identical to SEQ ID NO: 9083
  misc_feature 1..682: note = Synthetic polypeptide
  source 1..682: mol_type = other DNA

SEQ ID NO: 15298 - DNA, 347 bp, synthetic construct; identical to SEQ ID NO: 9084
  misc_feature 1..347: note = Synthetic polypeptide
  source 1..347: mol_type = other DNA

SEQ ID NO: 15299 - DNA, 273 bp, synthetic construct; identical to SEQ ID NO: 9085
  misc_feature 1..273: note = Synthetic polypeptide
  source 1..273: mol_type = other DNA

SEQ ID NO: 15300 - DNA, 317 bp, synthetic construct; identical to SEQ ID NO: 9086
  misc_feature 1..317: note = Synthetic polypeptide
  source 1..317: mol_type = other DNA

SEQ ID NO: 15301 - DNA, 369 bp, synthetic construct; identical to SEQ ID NO: 9087
  misc_feature 1..369: note = Synthetic polypeptide
  source 1..369: mol_type = other DNA

SEQ ID NO: 15302 - DNA, 175 bp, synthetic construct; identical to SEQ ID NO: 9088
  misc_feature 1..175: note = Synthetic polypeptide
  source 1..175: mol_type = other DNA

SEQ ID NO: 15303 - DNA, 370 bp, synthetic construct; identical to SEQ ID NO: 13309
  misc_feature 1..370: note = Synthetic polypeptide
  source 1..370: mol_type = other DNA

SEQ ID NO: 15304 - DNA, 361 bp, synthetic construct; identical to SEQ ID NO: 13310
  misc_feature 1..361: note = Synthetic polypeptide
  source 1..361: mol_type = other DNA

SEQ ID NO: 15305 - DNA, 1218 bp, synthetic construct; identical to SEQ ID NO: 8394
  misc_feature 1..1218: note = Synthetic polypeptide
  source 1..1218: mol_type = other DNA

SEQ ID NO: 15306 - DNA, 1053 bp, synthetic construct; identical to SEQ ID NO: 8395
  misc_feature 1..1053: note = Synthetic polypeptide
  source 1..1053: mol_type = other DNA

SEQ ID NO: 15307 - DNA, 942 bp, synthetic construct; identical to SEQ ID NO: 8396
  misc_feature 1..942: note = Synthetic polypeptide
  source 1..942: mol_type = other DNA

SEQ ID NO: 15308 - DNA, 1091 bp, synthetic construct; identical to SEQ ID NO: 8397
  misc_feature 1..1091: note = Synthetic polypeptide
  source 1..1091: mol_type = other DNA

SEQ ID NO: 15309 - DNA, 1418 bp, synthetic construct; identical to SEQ ID NO: 8618
  misc_feature 1..1418: note = Synthetic polypeptide
  source 1..1418: mol_type = other DNA

SEQ ID NO: 15310 - DNA, 1595 bp, synthetic construct; identical to SEQ ID NO: 8619
  misc_feature 1..1595: note = Synthetic polypeptide
  source 1..1595: mol_type = other DNA

SEQ ID NO: 15311 - DNA, 903 bp, synthetic construct; identical to SEQ ID NO: 8627
  misc_feature 1..903: note = Synthetic polypeptide
  source 1..903: mol_type = other DNA

SEQ ID NO: 15312 - DNA, 2920 bp, synthetic construct
  misc_feature 1..2920: note = Synthetic polypeptide
  source 1..2920: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15313 - DNA, 3151 bp, synthetic construct
  misc_feature 1..3151: note = Synthetic polypeptide
  source 1..3151: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15314 - DNA, 1281 bp, synthetic construct
  misc_feature 1..1281: note = Synthetic polypeptide
  source 1..1281: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15315 - DNA, 3133 bp, synthetic construct
  misc_feature 1..3133: note = Synthetic polypeptide
  source 1..3133: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15316 - DNA, 2296 bp, synthetic construct
  misc_feature 1..2296: note = Synthetic polypeptide
  source 1..2296: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15317 - DNA, 1465 bp, synthetic construct
  misc_feature 1..1465: note = Synthetic polypeptide
  source 1..1465: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15318 - DNA, 2920 bp, synthetic construct
  misc_feature 1..2920: note = Synthetic polypeptide
  source 1..2920: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15319 - DNA, 4725 bp, synthetic construct; identical to SEQ ID NO: 8344
  misc_feature 1..4725: note = Synthetic polypeptide
  source 1..4725: mol_type = other DNA

SEQ ID NO: 15320 - DNA, 4530 bp, synthetic construct; identical to SEQ ID NO: 8345
  misc_feature 1..4530: note = Synthetic polypeptide
  source 1..4530: mol_type = other DNA

SEQ ID NO: 15321 - DNA, 4557 bp, synthetic construct; identical to SEQ ID NO: 8346
  misc_feature 1..4557: note = Synthetic polypeptide
  source 1..4557: mol_type = other DNA

SEQ ID NO: 15322 - DNA, 4380 bp, synthetic construct; identical to SEQ ID NO: 8347
  misc_feature 1..4380: note = Synthetic polypeptide
  source 1..4380: mol_type = other DNA

SEQ ID NO: 15323 - DNA, 4548 bp, synthetic construct; identical to SEQ ID NO: 8348
  misc_feature 1..4548: note = Synthetic polypeptide
  source 1..4548: mol_type = other DNA

SEQ ID NO: 15324 - DNA, 4755 bp, synthetic construct; identical to SEQ ID NO: 8349
  misc_feature 1..4755: note = Synthetic polypeptide
  source 1..4755: mol_type = other DNA

SEQ ID NO: 15325 - DNA, 239 bp, synthetic construct; identical to SEQ ID NO: 13647
  misc_feature 1..239: note = Synthetic polypeptide
  source 1..239: mol_type = other DNA

SEQ ID NO: 15326 - DNA, 379 bp, synthetic construct; identical to SEQ ID NO: 13648
  misc_feature 1..379: note = Synthetic polypeptide
  source 1..379: mol_type = other DNA

SEQ ID NO: 15327 - DNA, 761 bp, synthetic construct; identical to SEQ ID NO: 13649
  misc_feature 1..761: note = Synthetic polypeptide
  source 1..761: mol_type = other DNA

SEQ ID NO: 15328 - DNA, 863 bp, synthetic construct; identical to SEQ ID NO: 13650
  misc_feature 1..863: note = Synthetic polypeptide
  source 1..863: mol_type = other DNA

SEQ ID NO: 15329 - DNA, 544 bp, synthetic construct; identical to SEQ ID NO: 8359
  misc_feature 1..544: note = Synthetic polypeptide
  source 1..544: mol_type = other DNA

SEQ ID NO: 15330 - DNA, 841 bp, synthetic construct; identical to SEQ ID NO: 8360
  misc_feature 1..841: note = Synthetic polypeptide
  source 1..841: mol_type = other DNA

SEQ ID NO: 15331 - DNA, 2660 bp, synthetic construct
  misc_feature 1..2660: note = Synthetic polypeptide
  source 1..2660: mol_type = other DNA
gtggcatgctggagccgactcatgtcagctggtgacagctgattgtgtgaatctcttcccaacttggtgtattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtgctccctgctcttgcccccgcccctgcctgtcctttgcccacctctcccccagtgcctgccccccacgtcacaccccatgccccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtga

SEQ ID NO: 15332 - DNA, 676 bp, synthetic construct; identical to SEQ ID NO: 8681
  misc_feature 1..676: note = Synthetic polypeptide
  source 1..676: mol_type = other DNA

SEQ ID NO: 15333 - DNA, 8628 bp, synthetic construct; identical to SEQ ID NO: 8507
  misc_feature 1..8628: note = Synthetic polypeptide
  source 1..8628: mol_type = other DNA

SEQ ID NO: 15334 - DNA, 8628 bp, synthetic construct; identical to SEQ ID NO: 8508
  misc_feature 1..8628: note = Synthetic polypeptide
  source 1..8628: mol_type = other DNA

SEQ ID NO: 15335 - DNA, 240 bp, synthetic construct; identical to SEQ ID NO: 8509
  misc_feature 1..240: note = Synthetic polypeptide
  source 1..240: mol_type = other DNA

SEQ ID NO: 15336 - DNA, 336 bp, synthetic construct; identical to SEQ ID NO: 8510
  misc_feature 1..336: note = Synthetic polypeptide
  source 1..336: mol_type = other DNA

SEQ ID NO: 15337 - DNA, 1065 bp, synthetic construct
  misc_feature 1..1065: note = Synthetic polypeptide
  source 1..1065: mol_type = other DNA
ttcctattttctatcgtttactaccataaaatatatacatatctattataaaaagttaaaaattatcaaaacttatgcacacacttacagaccatgcatgatgccatttgcagttgagagaagtgtaaacaaatgtaaagatgcagtgttaaataatatctgcataaaattgactctggtacatagtatactactctagtaatttcatagccacctcttgttgctattgcggtaaactcaagtgtttttaatatcacataccacacagttttaaaatgctgtgtggtgctaattatctcctcatgggtagttcttctttctagtaaattgtctattgcagtaaaaattgatctcctgcagttctcaaaatttttttgtgtttagtccaccatgggacccatacgaagtgctaccagtgatgctggaagtgctcccaagaagcagaaaaaagtgatatgacattgcaagaaaaagttggattgcttgatacgtaccgtagactgagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 15338 - DNA, 615 bp, synthetic construct
  misc_feature 1..615: note = Synthetic polypeptide
  source 1..615: mol_type = other DNA
ttcctattttctatcgtttactaccataaaatatatacatatctattataaaaagttaaaaattatcaaaacttatgcacacacttacagaccatgcatgatgccatttgcagttgagagaagtgtaaacaaatgtaaagatgcagtgttaaataatatctgcataaaattgactctggtacatagtatactactctagtaatttcatagccacctcttgttgctattgcggtaaactcaagtgtttttaatatcacataccacacagttttaaaatgctgtgtggtgctaattatctcctcatgggtagttcttctttctagtaaattgtctattgcagtaaaaattgatctcctgcagttctcaaaatttttttgtgtttagtccaccatgggacccatacgaagtgctaccagtgatgctggaagtgctcccaagaagcagaaaaaagtgatatgacattgcaagaaaaagttggattgcttgatacgtaccgtagactgagacctcttaagtcatgaaaatgcagcaacgctgaatgatgtaaagacattggtccagcaactatacaccacactgtgcattgagcagcaccagttaaacaaggaaagggag

SEQ ID NO: 15339 - DNA, 509 bp, synthetic construct; identical to SEQ ID NO: 7445
  misc_feature 1..509: note = Synthetic polypeptide
  source 1..509: mol_type = other DNA

SEQ ID NO: 15340 - DNA, 1808 bp, synthetic construct; identical to SEQ ID NO: 8393
  misc_feature 1..1808: note = Synthetic polypeptide
  source 1..1808: mol_type = other DNA

SEQ ID NO: 15341 - DNA, 588 bp, synthetic construct; identical to SEQ ID NO: 7495
  misc_feature 1..588: note = Synthetic polypeptide
  source 1..588: mol_type = other DNA

SEQ ID NO: 15342 - DNA, 1763 bp, synthetic construct; identical to SEQ ID NO: 8650
  misc_feature 1..1763: note = Synthetic polypeptide
  source 1..1763: mol_type = other DNA

SEQ ID NO: 15343 - DNA, 1724 bp, synthetic construct; identical to SEQ ID NO: 8651
  misc_feature 1..1724: note = Synthetic polypeptide
  source 1..1724: mol_type = other DNA

SEQ ID NO: 15344 - DNA, 796 bp, synthetic construct; identical to SEQ ID NO: 8676
  misc_feature 1..796: note = Synthetic polypeptide
  source 1..796: mol_type = other DNA

SEQ ID NO: 15345 - DNA, 272 bp, synthetic construct; identical to SEQ ID NO: 8677
  misc_feature 1..272: note = Synthetic polypeptide
  source 1..272: mol_type = other DNA

SEQ ID NO: 15346 - DNA, 226 bp, synthetic construct; identical to SEQ ID NO: 8678
  misc_feature 1..226: note = Synthetic polypeptide
  source 1..226: mol_type = other DNA

SEQ ID NO: 15347 - DNA, 175 bp, synthetic construct; identical to SEQ ID NO: 8679
  misc_feature 1..175: note = Synthetic polypeptide
  source 1..175: mol_type = other DNA

SEQ ID NO: 15348 - DNA, 2471 bp, synthetic construct; identical to SEQ ID NO: 576
  misc_feature 1..2471: note = Synthetic polypeptide
  source 1..2471: mol_type = other DNA

SEQ ID NO: 15349 - DNA, 459 bp, synthetic construct; identical to SEQ ID NO: 8555
  misc_feature 1..459: note = Synthetic polypeptide
  source 1..459: mol_type = other DNA

SEQ ID NO: 15350 - DNA, 1927 bp, synthetic construct; identical to SEQ ID NO: 8368
  misc_feature 1..1927: note = Synthetic polypeptide
  source 1..1927: mol_type = other DNA

SEQ ID NO: 15351 - DNA, 1681 bp, synthetic construct; identical to SEQ ID NO: 8523
  misc_feature 1..1681: note = Synthetic polypeptide
  source 1..1681: mol_type = other DNA

SEQ ID NO: 15352 - DNA, 1477 bp, synthetic construct
  misc_feature 1..1477: note = Synthetic polypeptide
  source 1..1477: mol_type = other DNA
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaa

SEQ ID NO: 15353 - DNA, 1600 bp, synthetic construct
  misc_feature 1..1600: note = Synthetic polypeptide
  source 1..1600: mol_type = other DNA
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagcagactgctcattcctcacattgccatgggaagttgtaatggtctctgctgcccccaagctgaggagccttagactccaatacaagggaggaaggggaagagcaagatttttattcccactgaataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaa

SEQ ID NO: 15354 - DNA, 1390 bp, synthetic construct
  misc_feature 1..1390: note = Synthetic polypeptide
  source 1..1390: mol_type = other DNA
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctga

SEQ ID NO: 15355 - DNA, 1423 bp, synthetic construct
  misc_feature 1..1423: note = Synthetic polypeptide
  source 1..1423: mol_type = other DNA
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatag

SEQ ID NO: 15356 - DNA, 1643 bp, synthetic construct; identical to SEQ ID NO: 7549
  misc_feature 1..1643: note = Synthetic polypeptide
  source 1..1643: mol_type = other DNA

SEQ ID NO: 15357 - DNA, 1457 bp, synthetic construct; identical to SEQ ID NO: 7550
  misc_feature 1..1457: note = Synthetic polypeptide
  source 1..1457: mol_type = other DNA

SEQ ID NO: 15358 - DNA, 554 bp, synthetic construct; identical to SEQ ID NO: 8221
  misc_feature 1..554: note = Synthetic polypeptide
  source 1..554: mol_type = other DNA

SEQ ID NO: 15359 - DNA, 482 bp, synthetic construct; identical to SEQ ID NO: 8222
  misc_feature 1..482: note = Synthetic polypeptide
  source 1..482: mol_type = other DNA

SEQ ID NO: 15360 - DNA, 1227 bp, synthetic construct; identical to SEQ ID NO: 8469
  misc_feature 1..1227: note = Synthetic polypeptide
  source 1..1227: mol_type = other DNA

SEQ ID NO: 15361 - DNA, 1215 bp, synthetic construct; identical to SEQ ID NO: 8470
  misc_feature 1..1215: note = Synthetic polypeptide
  source 1..1215: mol_type = other DNA

SEQ ID NO: 15362 - DNA, 555 bp, synthetic construct; identical to SEQ ID NO: 8471
  misc_feature 1..555: note = Synthetic polypeptide
  source 1..555: mol_type = other DNA

SEQ ID NO: 15363 - DNA, 300 bp, synthetic construct; identical to SEQ ID NO: 8472
  misc_feature 1..300: note = Synthetic polypeptide
  source 1..300: mol_type = other DNA

SEQ ID NO: 15364 - DNA, 395 bp, synthetic construct
  misc_feature 1..395: note = Synthetic polypeptide
  source 1..395: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15365 - DNA, 386 bp, synthetic construct
  misc_feature 1..386: note = Synthetic polypeptide
  source 1..386: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15366 - DNA, 887 bp, synthetic construct; identical to SEQ ID NO: 12985
  misc_feature 1..887: note = Synthetic polypeptide
  source 1..887: mol_type = other DNA

SEQ ID NO: 15367 - DNA, 959 bp, synthetic construct; identical to SEQ ID NO: 7258
  misc_feature 1..959: note = Synthetic polypeptide
  source 1..959: mol_type = other DNA

SEQ ID NO: 15368 - DNA, 649 bp, synthetic construct; identical to SEQ ID NO: 7259
  misc_feature 1..649: note = Synthetic polypeptide
  source 1..649: mol_type = other DNA

SEQ ID NO: 15369 - DNA, 1533 bp, synthetic construct; identical to SEQ ID NO: 8543
  misc_feature 1..1533: note = Synthetic polypeptide
  source 1..1533: mol_type = other DNA

SEQ ID NO: 15370 - DNA, 1382 bp, synthetic construct; identical to SEQ ID NO: 8693
  misc_feature 1..1382: note = Synthetic polypeptide
  source 1..1382: mol_type = other DNA

SEQ ID NO: 15371 - DNA, 1253 bp, synthetic construct; identical to SEQ ID NO: 8694
  misc_feature 1..1253: note = Synthetic polypeptide
  source 1..1253: mol_type = other DNA

SEQ ID NO: 15372 - DNA, 2419 bp, synthetic construct; identical to SEQ ID NO: 7455
  misc_feature 1..2419: note = Synthetic polypeptide
  source 1..2419: mol_type = other DNA

SEQ ID NO: 15373 - DNA, 198 bp, synthetic construct; identical to SEQ ID NO: 8406
  misc_feature 1..198: note = Synthetic polypeptide
  source 1..198: mol_type = other DNA

SEQ ID NO: 15374 - DNA, 2000 bp, synthetic construct
  misc_feature 1..2000: note = Synthetic polypeptide
  source 1..2000: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15375 - DNA, 2231 bp, synthetic construct
  misc_feature 1..2231: note = Synthetic polypeptide
  source 1..2231: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15376 - DNA, 361 bp, synthetic construct
  misc_feature 1..361: note = Synthetic polypeptide
  source 1..361: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15377 - DNA, 2213 bp, synthetic construct
  misc_feature 1..2213: note = Synthetic polypeptide
  source 1..2213: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15378 - DNA, 1376 bp, synthetic construct
  misc_feature 1..1376: note = Synthetic polypeptide
  source 1..1376: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15379 - DNA, 545 bp, synthetic construct
  misc_feature 1..545: note = Synthetic polypeptide
  source 1..545: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15380 - DNA, 2000 bp, synthetic construct
  misc_feature 1..2000: note = Synthetic polypeptide
  source 1..2000: mol_type = other DNA
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15381 - DNA, 451 bp, synthetic construct; identical to SEQ ID NO: 10444
  misc_feature 1..451: note = Synthetic polypeptide
  source 1..451: mol_type = other DNA

SEQ ID NO: 15382 - DNA, 513 bp, synthetic construct; identical to SEQ ID NO: 10445
  misc_feature 1..513: note = Synthetic polypeptide
  source 1..513: mol_type = other DNA

SEQ ID NO: 15383 - DNA, 289 bp, synthetic construct; identical to SEQ ID NO: 10446
  misc_feature 1..289: note = Synthetic polypeptide
  source 1..289: mol_type = other DNA

SEQ ID NO: 15384 - DNA, 124 bp, synthetic construct; identical to SEQ ID NO: 10447
  misc_feature 1..124: note = Synthetic polypeptide
  source 1..124: mol_type = other DNA

SEQ ID NO: 15385 - DNA, 2593 bp, synthetic construct; identical to SEQ ID NO: 10448
  misc_feature 1..2593: note = Synthetic polypeptide
  source 1..2593: mol_type = other DNA

SEQ ID NO: 15386 - DNA, 2590 bp, synthetic construct; identical to SEQ ID NO: 10449
  misc_feature 1..2590: note = Synthetic polypeptide
  source 1..2590: mol_type = other DNA

SEQ ID NO: 15387 - DNA, 571 bp, synthetic construct; identical to SEQ ID NO: 12588
  misc_feature 1..571: note = Synthetic polypeptide
  source 1..571: mol_type = other DNA

SEQ ID NO: 15388 - DNA, 307 bp, synthetic construct; identical to SEQ ID NO: 12589
  misc_feature 1..307: note = Synthetic polypeptide
  source 1..307: mol_type = other DNA

SEQ ID NO: 15389 - DNA, 497 bp, synthetic construct
  misc_feature 1..497: note = Synthetic polypeptide
  source 1..497: mol_type = other DNA
gaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaa

SEQ ID NO: 15390 - DNA, 794 bp, synthetic construct
  misc_feature 1..794: note = Synthetic polypeptide
  source 1..794: mol_type = other DNA
gaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaa

SEQ ID NO: 15391 - DNA, 5258 bp, synthetic construct
  misc_feature 1..5258: note = Synthetic polypeptide
  source 1..5258: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtga

SEQ ID NO: 15392 - DNA, 5426 bp, synthetic construct
  misc_feature 1..5426: note = Synthetic polypeptide
  source 1..5426: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15393 - DNA, 5282 bp, synthetic construct
  misc_feature 1..5282: note = Synthetic polypeptide
  source 1..5282: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15394 - DNA, 5321 bp, synthetic construct
  misc_feature 1..5321: note = Synthetic polypeptide
  source 1..5321: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15395 - DNA, 5321 bp, synthetic construct
  misc_feature 1..5321: note = Synthetic polypeptide
  source 1..5321: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaggccaagtcaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15396 - DNA, 221 bp, synthetic construct
  misc_feature 1..221: note = Synthetic polypeptide
  source 1..221: mol_type = other DNA
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggctggtcacagtggctcacatctctaattccagcactttgggaggccaaggcaagaggatcacttga

SEQ ID NO: 15397 - DNA, 1584 bp, synthetic construct; identical to SEQ ID NO: 8495
  misc_feature 1..1584: note = Synthetic polypeptide
  source 1..1584: mol_type = other DNA

SEQ ID NO: 15398 - DNA, 1242 bp, synthetic construct; identical to SEQ ID NO: 8496
  misc_feature 1..1242: note = Synthetic polypeptide
  source 1..1242: mol_type = other DNA

SEQ ID NO: 15399 - DNA, 1539 bp, synthetic construct; identical to SEQ ID NO: 8497
  misc_feature 1..1539: note = Synthetic polypeptide
  source 1..1539: mol_type = other DNA

SEQ ID NO: 15400 - DNA, 1623 bp, synthetic construct; identical to SEQ ID NO: 8498
  misc_feature 1..1623: note = Synthetic polypeptide
  source 1..1623: mol_type = other DNA

SEQ ID NO: 15401 - DNA, 1677 bp, synthetic construct; identical to SEQ ID NO: 8499
  misc_feature 1..1677: note = Synthetic polypeptide
  source 1..1677: mol_type = other DNA

SEQ ID NO: 15402 - DNA, 1632 bp, synthetic construct; identical to SEQ ID NO: 8500
  misc_feature 1..1632: note = Synthetic polypeptide
  source 1..1632: mol_type = other DNA

SEQ ID NO: 15403 - DNA, 555 bp, synthetic construct; identical to SEQ ID NO: 8501
  misc_feature 1..555: note = Synthetic polypeptide
  source 1..555: mol_type = other DNA

SEQ ID NO: 15404 - DNA, 401 bp, synthetic construct; identical to SEQ ID NO: 8502
  misc_feature 1..401: note = Synthetic polypeptide
  source 1..401: mol_type = other DNA

SEQ ID NO: 15405 - DNA, 166 bp, synthetic construct; identical to SEQ ID NO: 8503
  misc_feature 1..166: note = Synthetic polypeptide
  source 1..166: mol_type = other DNA

SEQ ID NO: 15406 - DNA, 841 bp, synthetic construct
  misc_feature 1..841: note = Synthetic polypeptide
  source 1..841: mol_type = other DNA
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctag

SEQ ID NO: 15407 - DNA, 572 bp, synthetic construct
  misc_feature 1..572: note = Synthetic polypeptide
  source 1..572: mol_type = other DNA
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggacaaggtcccagaaccctgggtgccctgcagcctgggttcagtgcccggagcccgtcctacctgggaacaatgcgcggctgatcatgcccggcatgatgatcaggcccatggggagcatc

SEQ ID NO: 15408 - DNA, 2795 bp, synthetic construct
  misc_feature 1..2795: note = Synthetic polypeptide
  source 1..2795: mol_type = other DNA
cttgcacatgaatgttggcagcagctttattggtagtagccccagaactggaaataaaatatttgaatagataagcagggtgtggcgcgtgcacacggtgcaccgacgccggctgtgagagggaaggagcatgcgtgcagccgcgtgggggagtctcacggtgactttaccgaggaaaatgaaccagacggaaagacagcactctgtgcgcctccacttagttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttga

SEQ ID NO: 15409 - DNA, 732 bp, synthetic construct; identical to SEQ ID NO: 7769
  misc_feature 1..732: note = Synthetic polypeptide
  source 1..732: mol_type = other DNA

SEQ ID NO: 15410 - DNA, 879 bp, synthetic construct; identical to SEQ ID NO: 7770
  misc_feature 1..879: note = Synthetic polypeptide
  source 1..879: mol_type = other DNA

SEQ ID NO: 15411 - DNA, 99 bp, synthetic construct; identical to SEQ ID NO: 7771
  misc_feature 1..99: note = Synthetic polypeptide
  source 1..99: mol_type = other DNA

SEQ ID NO: 15412 - DNA, 503 bp, synthetic construct
  misc_feature 1..503: note = Synthetic polypeptide
  source 1..503: mol_type = other DNA
ggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctag

SEQ ID NO: 15413 - DNA, 234 bp, synthetic construct
  misc_feature 1..234: note = Synthetic polypeptide
  source 1..234: mol_type = other DNA
ggcggcggcggcggcggcggcggccgggggcgattaagtacacgggcttcagggaccggccccacgaggaacgccaggcacgcttccagaacgcctgccgcgacggccgctcggaaatcgtatatttgaaggctcccatgattctgaatggagtctgtgttatctggaaaggctggattgatctccaaagactggatggtatgggctgtctggagtttgatgaggagcgagccc

SEQ ID NO: 15414 - DNA, 518 bp, synthetic construct
  misc_feature 1..518: note = Synthetic polypeptide
  source 1..518: mol_type = other DNA
ggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaa

SEQ ID NO: 15415 - DNA, 188 bp, synthetic construct
  misc_feature 1..188: note = Synthetic polypeptide
  source 1..188: mol_type = other DNA
ggcggcggcggcggcggcggcggccgggggcgattaagtacacgggcttcagggaccggccccacgaggaacgccaggcacgcttccagaacgcctgccgcgacggccgctcggaaatcgcaagaagacaacaagaccctagtcctggttccaatttaggtggtggtgatgacctcaaacttcgttaa

SEQ ID NO: 15416 - DNA, 564 bp, synthetic construct; identical to SEQ ID NO: 8405
  misc_feature 1..564: note = Synthetic polypeptide
  source 1..564: mol_type = other DNA

SEQ ID NO: 15417 - DNA, 1285 bp, synthetic construct
  misc_feature 1..1285: note = Synthetic polypeptide
  source 1..1285: mol_type = other DNA
aaaaaaaaaaaaaaaaaaaaaaaaaaaaaaaaaaaaaaaaaagaggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatag

SEQ ID NO: 15418 - DNA, 68 bp, synthetic construct
  misc_feature 1..68: note = Synthetic polypeptide
  source 1..68: mol_type = other DNA
aaaaaaaaaaaaaaaaaaaaaaaaaaaaaaaaaaaaaaaaaagaggatcggaagagtcttcaaaaacg

SEQ ID NO: 15419 - DNA, 567 bp, synthetic construct
  misc_feature 1..567: note = Synthetic polypeptide
  source 1..567: mol_type = other DNA
gccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaa

SEQ ID NO: 15420 - DNA, 222 bp, synthetic construct
  misc_feature 1..222: note = Synthetic polypeptide
  source 1..222: mol_type = other DNA
gccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtacacatttggtgcggctctgttcgtgggctgggtcgctggaggcctcacactaa

SEQ ID NO: 15421 - DNA, 2625 bp, synthetic construct
  misc_feature 1..2625: note = Synthetic polypeptide
  source 1..2625: mol_type = other DNA
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15422 - DNA, 1455 bp, synthetic construct
  misc_feature 1..1455: note = Synthetic polypeptide
  source 1..1455: mol_type = other DNA
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggttcacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15423 - DNA, 198 bp, synthetic construct
  misc_feature 1..198: note = Synthetic polypeptide
  source 1..198: mol_type = other DNA
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggtcatatcagaggagctgagttggcagaccgggcccccctga

SEQ ID NO: 15424 - DNA, 6463 bp, synthetic construct; identical to SEQ ID NO: 8580
  misc_feature 1..6463: note = Synthetic polypeptide
  source 1..6463: mol_type = other DNA

SEQ ID NO: 15425 - DNA, 1571 bp, synthetic construct; identical to SEQ ID NO: 6810
  misc_feature 1..1571: note = Synthetic polypeptide
  source 1..1571: mol_type = other DNA

SEQ ID NO: 15426 - DNA, 1151 bp, synthetic construct; identical to SEQ ID NO: 13411
  misc_feature 1..1151: note = Synthetic polypeptide
  source 1..1151: mol_type = other DNA

SEQ ID NO: 15427 - DNA, 3171 bp, synthetic construct
  misc_feature 1..3171: note = Synthetic polypeptide
  source 1..3171: mol_type = other DNA
cttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttga

SEQ ID NO: 15428 - DNA, 466 bp, synthetic construct; identical to SEQ ID NO: 8369
  misc_feature 1..466: note = Synthetic polypeptide
  source 1..466: mol_type = other DNA

SEQ ID NO: 15429 - DNA, 526 bp, synthetic construct; identical to SEQ ID NO: 8370
  misc_feature 1..526: note = Synthetic polypeptide
  source 1..526: mol_type = other DNA

SEQ ID NO: 15430 - DNA, 319 bp, synthetic construct; identical to SEQ ID NO: 8371
  misc_feature 1..319: note = Synthetic polypeptide
  source 1..319: mol_type = other DNA

SEQ ID NO: 15431 - DNA, 520 bp, synthetic construct; identical to SEQ ID NO: 8372
  misc_feature 1..520: note = Synthetic polypeptide
  source 1..520: mol_type = other DNA

SEQ ID NO: 15432 - DNA, 3180 bp, synthetic construct
  misc_feature 1..3180: note = Synthetic polypeptide
  source 1..3180: mol_type = other DNA
agcacccctcttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtga

SEQ ID NO: 15433 - DNA, 3315 bp, synthetic construct
  misc_feature 1..3315: note = Synthetic polypeptide
  source 1..3315: mol_type = other DNA
agcacccctcttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattag

SEQ ID NO: 15434 - DNA, 35 bp, synthetic construct
  misc_feature 1..35: note = Synthetic polypeptide
  source 1..35: mol_type = other DNA
agcacccctcttggcacacagtttgcattttttaa

SEQ ID NO: 15435 - DNA, 967 bp, synthetic construct
  misc_feature 1..967: note = Synthetic polypeptide
  source 1..967: mol_type = other DNA
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaa

SEQ ID NO: 15436 - DNA, 1839 bp, synthetic construct
  misc_feature 1..1839: note = Synthetic polypeptide
  source 1..1839: mol_type = other DNA
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaa

SEQ ID NO: 15437 - DNA, 1842 bp, synthetic construct
  misc_feature 1..1842: note = Synthetic polypeptide
  source 1..1842: mol_type = other DNA
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactag

SEQ ID NO: 15438 - DNA, 1084 bp, synthetic construct; identical to SEQ ID NO: 580
  misc_feature 1..1084: note = Synthetic polypeptide
  source 1..1084: mol_type = other DNA

SEQ ID NO: 15439 - DNA, 117 bp, synthetic construct; identical to SEQ ID NO: 8388
  misc_feature 1..117: note = Synthetic polypeptide
  source 1..117: mol_type = other DNA

SEQ ID NO: 15440 - DNA, 1110 bp, synthetic construct; identical to SEQ ID NO: 8310
  misc_feature 1..1110: note = Synthetic polypeptide
  source 1..1110: mol_type = other DNA

SEQ ID NO: 15441 - DNA, 358 bp, synthetic construct
  misc_feature 1..358: note = Synthetic polypeptide
  source 1..358: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15442 - DNA, 349 bp, synthetic construct
  misc_feature 1..349: note = Synthetic polypeptide
  source 1..349: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15443 - DNA, 864 bp, synthetic construct; identical to SEQ ID NO: 6737
  misc_feature 1..864: note = Synthetic polypeptide
  source 1..864: mol_type = other DNA

SEQ ID NO: 15444 - DNA, 619 bp, synthetic construct
  misc_feature 1..619: note = Synthetic polypeptide
  source 1..619: mol_type = other DNA
tcctaacccagggctcaaagaccagtgtgtgagcctcagggggcgtgtctctaagctcccggaaaccaagccaattttcgcatgcgtgttcttctttgctttttttctgggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaa

SEQ ID NO: 15445 - DNA, 864 bp, synthetic construct; identical to SEQ ID NO: 6975
  misc_feature 1..864: note = Synthetic polypeptide
  source 1..864: mol_type = other DNA

SEQ ID NO: 15446 - DNA, 471 bp, synthetic construct; identical to SEQ ID NO: 6976
  misc_feature 1..471: note = Synthetic polypeptide
  source 1..471: mol_type = other DNA

SEQ ID NO: 15447 - DNA, 380 bp, synthetic construct
  misc_feature 1..380: note = Synthetic polypeptide
  source 1..380: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 15448 - DNA, 442 bp, synthetic construct
  misc_feature 1..442: note = Synthetic polypeptide
  source 1..442: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 15449 - DNA, 218 bp, synthetic construct
  misc_feature 1..218: note = Synthetic polypeptide
  source 1..218: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 15450 - DNA, 2075 bp, synthetic construct
  misc_feature 1..2075: note = Synthetic polypeptide
  source 1..2075: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15451 - DNA, 2522 bp, synthetic construct
  misc_feature 1..2522: note = Synthetic polypeptide
  source 1..2522: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15452 - DNA, 2519 bp, synthetic construct
  misc_feature 1..2519: note = Synthetic polypeptide
  source 1..2519: mol_type = other DNA
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15453 - DNA, 1508 bp, synthetic construct; identical to SEQ ID NO: 7729
  misc_feature 1..1508: note = Synthetic polypeptide
  source 1..1508: mol_type = other DNA

SEQ ID NO: 15454 - DNA, 603 bp, synthetic construct; identical to SEQ ID NO: 7730
  misc_feature 1..603: note = Synthetic polypeptide
  source 1..603: mol_type = other DNA

SEQ ID NO: 15455 - DNA, 909 bp, synthetic construct; identical to SEQ ID NO: 7731
  misc_feature 1..909: note = Synthetic polypeptide
  source 1..909: mol_type = other DNA

SEQ ID NO: 15456 - DNA, 12665 bp, synthetic construct; identical to SEQ ID NO: 8581
  misc_feature 1..12665: note = Synthetic polypeptide
  source 1..12665: mol_type = other DNA

SEQ ID NO: 15457 - DNA, 4559 bp, synthetic construct; identical to SEQ ID NO: 8582
  misc_feature 1..4559: note = Synthetic polypeptide
  source 1..4559: mol_type = other DNA

SEQ ID NO: 15458 - DNA, 3692 bp, synthetic construct; identical to SEQ ID NO: 8610
  misc_feature 1..3692: note = Synthetic polypeptide
  source 1..3692: mol_type = other DNA

SEQ ID NO: 15459 - DNA, 3536 bp, synthetic construct; identical to SEQ ID NO: 8611
  misc_feature 1..3536: note = Synthetic polypeptide
  source 1..3536: mol_type = other DNA

SEQ ID NO: 15460 - DNA, 3647 bp, synthetic construct; identical to SEQ ID NO: 8612
  misc_feature 1..3647: note = Synthetic polypeptide
  source 1..3647: mol_type = other DNA

SEQ ID NO: 15461 - DNA, 2158 bp, synthetic construct; identical to SEQ ID NO: 8400
  misc_feature 1..2158: note = Synthetic polypeptide
  source 1..2158: mol_type = other DNA

SEQ ID NO: 15462 - DNA, 2224 bp, synthetic construct; identical to SEQ ID NO: 8401
  misc_feature 1..2224: note = Synthetic polypeptide
  source 1..2224: mol_type = other DNA

SEQ ID NO: 15463 - DNA, 2143 bp, synthetic construct; identical to SEQ ID NO: 8402
  misc_feature 1..2143: note = Synthetic polypeptide
  source 1..2143: mol_type = other DNA

SEQ ID NO: 15464 - DNA, 796 bp, synthetic construct; identical to SEQ ID NO: 8403
  misc_feature 1..796: note = Synthetic polypeptide
  source 1..796: mol_type = other DNA

SEQ ID NO: 15465 - DNA, 740 bp, synthetic construct; identical to SEQ ID NO: 7794
  misc_feature 1..740: note = Synthetic polypeptide
  source 1..740: mol_type = other DNA

SEQ ID NO: 15466 - DNA, 2433 bp, synthetic construct; identical to SEQ ID NO: 8511
  misc_feature 1..2433: note = Synthetic polypeptide
  source 1..2433: mol_type = other DNA

SEQ ID NO: 15467 - DNA, 380 bp, synthetic construct; identical to SEQ ID NO: 8512
  misc_feature 1..380: note = Synthetic polypeptide
  source 1..380: mol_type = other DNA

SEQ ID NO: 15468 - DNA, 257 bp, synthetic construct; identical to SEQ ID NO: 8513
  misc_feature 1..257: note = Synthetic polypeptide
  source 1..257: mol_type = other DNA

SEQ ID NO: 15469 - DNA, 250 bp, synthetic construct; identical to SEQ ID NO: 8514
  misc_feature 1..250: note = Synthetic polypeptide
  source 1..250: mol_type = other DNA

SEQ ID NO: 15470 - DNA, 285 bp, synthetic construct; identical to SEQ ID NO: 6932
  misc_feature 1..285: note = Synthetic polypeptide
  source 1..285: mol_type = other DNA

SEQ ID NO: 15471 - DNA, 333 bp, synthetic construct; identical to SEQ ID NO: 6933
  misc_feature 1..333: note = Synthetic polypeptide
  source 1..333: mol_type = other DNA

SEQ ID NO: 15472 - DNA, 207 bp, synthetic construct; identical to SEQ ID NO: 6934
  misc_feature 1..207: note = Synthetic polypeptide
  source 1..207: mol_type = other DNA

SEQ ID NO: 15473 - DNA, 555 bp, synthetic construct; identical to SEQ ID NO: 6935
  misc_feature 1..555: note = Synthetic polypeptide
  source 1..555: mol_type = other DNA

SEQ ID NO: 15474 - DNA, 225 bp, synthetic construct; identical to SEQ ID NO: 6936
  misc_feature 1..225: note = Synthetic polypeptide
  source 1..225: mol_type = other DNA

SEQ ID NO: 15475 - DNA, 308 bp, synthetic construct
  misc_feature 1..308: note = Synthetic polypeptide
  source 1..308: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgct

SEQ ID NO: 15476 - DNA, 649 bp, synthetic construct
  misc_feature 1..649: note = Synthetic polypeptide
  source 1..649: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttc

SEQ ID NO: 15477 - DNA, 491 bp, synthetic construct
  misc_feature 1..491: note = Synthetic polypeptide
  source 1..491: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccggga

SEQ ID NO: 15478 - DNA, 501 bp, synthetic construct
  misc_feature 1..501: note = Synthetic polypeptide
  source 1..501: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttc

SEQ ID NO: 15479 - DNA, 3076 bp, synthetic construct
  misc_feature 1..3076: note = Synthetic polypeptide
  source 1..3076: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 15480 - DNA, 2739 bp, synthetic construct
  misc_feature 1..2739: note = Synthetic polypeptide
  source 1..2739: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaagga

SEQ ID NO: 15481 - DNA, 2815 bp, synthetic construct
  misc_feature 1..2815: note = Synthetic polypeptide
  source 1..2815: mol_type = other DNA
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctgacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 15482 - DNA, 574 bp, synthetic construct
  misc_feature 1..574: note = Synthetic polypeptide
  source 1..574: mol_type = other DNA
ttttttaaaaatgagacagtattgcatacacagcagaatggctaacgtcttttaaactggcaatatcaagtattggcaagggtgtggaatggtggtacctcataatcctgctgatagaagtataattggtacaaccattttggaaactgtttatcatcactgcttacatttgaacacatgcataccctgtgatctaagatttccactcctaggtatatctccagcagaagagataaatccagaaatgcttttggcagcattattagtaagaacggaaacaacccaaaagcttatcaatagtagaatggttaaataaactatgatgaagtcacacaatataatataatggaaatgaatagactgcagctacacacaaaaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 15483 - DNA, 1052 bp, synthetic construct; identical to SEQ ID NO: 13297
  misc_feature 1..1052: note = Synthetic polypeptide
  source 1..1052: mol_type = other DNA

SEQ ID NO: 15484 - DNA, 483 bp, synthetic construct; identical to SEQ ID NO: 13298
  misc_feature 1..483: note = Synthetic polypeptide
  source 1..483: mol_type = other DNA

SEQ ID NO: 15485 - DNA, 402 bp, synthetic construct; identical to SEQ ID NO: 13299
  misc_feature 1..402: note = Synthetic polypeptide
  source 1..402: mol_type = other DNA

SEQ ID NO: 15486 - DNA, 230 bp, synthetic construct; identical to SEQ ID NO: 13300
  misc_feature 1..230: note = Synthetic polypeptide
  source 1..230: mol_type = other DNA

SEQ ID NO: 15487 - DNA, 866 bp, synthetic construct; identical to SEQ ID NO: 13301
  misc_feature 1..866: note = Synthetic polypeptide
  source 1..866: mol_type = other DNA

SEQ ID NO: 15488 - DNA, 365 bp, synthetic construct
  misc_feature 1..365: note = Synthetic polypeptide
  source 1..365: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15489 - DNA, 356 bp, synthetic construct
  misc_feature 1..356: note = Synthetic polypeptide
  source 1..356: mol_type = other DNA
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15490 - DNA, 477 bp, synthetic construct; identical to SEQ ID NO: 8538
  misc_feature 1..477: note = Synthetic polypeptide
  source 1..477: mol_type = other DNA

SEQ ID NO: 15491 - DNA, 1219 bp, synthetic construct; identical to SEQ ID NO: 7808
  misc_feature 1..1219: note = Synthetic polypeptide
  source 1..1219: mol_type = other DNA

SEQ ID NO: 15492 - DNA, 2887 bp, synthetic construct; identical to SEQ ID NO: 8311
  misc_feature 1..2887: note = Synthetic polypeptide
  source 1..2887: mol_type = other DNA

SEQ ID NO: 15493 - DNA, 2941 bp, synthetic construct; identical to SEQ ID NO: 8312
  misc_feature 1..2941: note = Synthetic polypeptide
  source 1..2941: mol_type = other DNA

SEQ ID NO: 15494 - DNA, 2980 bp, synthetic construct; identical to SEQ ID NO: 8313
  misc_feature 1..2980: note = Synthetic polypeptide
  source 1..2980: mol_type = other DNA

SEQ ID NO: 15495 - DNA, 2887 bp, synthetic construct; identical to SEQ ID NO: 8314
  misc_feature 1..2887: note = Synthetic polypeptide
  source 1..2887: mol_type = other DNA

SEQ ID NO: 15496 - DNA, 3046 bp, synthetic construct; identical to SEQ ID NO: 8315
  misc_feature 1..3046: note = Synthetic polypeptide
  source 1..3046: mol_type = other DNA

SEQ ID NO: 15497 - DNA, 2959 bp, synthetic construct; identical to SEQ ID NO: 8316
  misc_feature 1..2959: note = Synthetic polypeptide
  source 1..2959: mol_type = other DNA

SEQ ID NO: 15498 - DNA, 2941 bp, synthetic construct; identical to SEQ ID NO: 8317
  misc_feature 1..2941: note = Synthetic polypeptide
  source 1..2941: mol_type = other DNA

SEQ ID NO: 15499 - DNA, 940 bp, synthetic construct; identical to SEQ ID NO: 8318
  misc_feature 1..940: note = Synthetic polypeptide
  source 1..940: mol_type = other DNA

SEQ ID NO: 15500 - DNA, 768 bp, synthetic construct
  misc_feature 1..768: note = Synthetic polypeptide
  source 1..768: mol_type = other DNA
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatga

SEQ ID NO: 15501 - DNA, 876 bp, synthetic construct
  misc_feature 1..876: note = Synthetic polypeptide
  source 1..876: mol_type = other DNA
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatga

SEQ ID NO: 15502 - DNA, 324 bp, synthetic construct
  misc_feature 1..324: note = Synthetic polypeptide
  source 1..324: mol_type = other DNA
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagggtcttactctgtcactcaggttggagtgcagtggcacgatcttggctcattgcagcctcgacctcctgggctcaagcgatccttcgacctcagcctcccaagtag

SEQ ID NO: 15503 - DNA, 276 bp, synthetic construct
  misc_feature 1..276: note = Synthetic polypeptide
  source 1..276: mol_type = other DNA
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagtagagacggagggtttcaccgtgttagccaggatggtctggatctcctgaccttgtga

SEQ ID NO: 15504 - DNA, 763 bp, synthetic construct; identical to SEQ ID NO: 606
  misc_feature 1..763: note = Synthetic polypeptide
  source 1..763: mol_type = other DNA

SEQ ID NO: 15505 - DNA, 303 bp, synthetic construct
  misc_feature 1..303: note = Synthetic polypeptide
  source 1..303: mol_type = other DNA
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagcaagagacccaaaagattcaatcaaatgatggaaaggaattggatataa

SEQ ID NO: 15506 - DNA, 1080 bp, synthetic construct
  misc_feature 1..1080: note = Synthetic polypeptide
  source 1..1080: mol_type = other DNA
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaa

SEQ ID NO: 15507 - DNA, 912 bp, synthetic construct
  misc_feature 1..912: note = Synthetic polypeptide
  source 1..912: mol_type = other DNA
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaa

SEQ ID NO: 15508 - DNA, 2397 bp, synthetic construct; identical to SEQ ID NO: 8486
  misc_feature 1..2397: note = Synthetic polypeptide
  source 1..2397: mol_type = other DNA

SEQ ID NO: 15509 - DNA, 2412 bp, synthetic construct; identical to SEQ ID NO: 8487
  misc_feature 1..2412: note = Synthetic polypeptide
  source 1..2412: mol_type = other DNA

SEQ ID NO: 15510 - DNA, 55 bp, synthetic construct; identical to SEQ ID NO: 8488
  misc_feature 1..55: note = Synthetic polypeptide
  source 1..55: mol_type = other DNA

SEQ ID NO: 15511 - DNA, 2328 bp, synthetic construct; identical to SEQ ID NO: 8489
  misc_feature 1..2328: note = Synthetic polypeptide
  source 1..2328: mol_type = other DNA

SEQ ID NO: 15512 - DNA, 249 bp, synthetic construct; identical to SEQ ID NO: 8490
  misc_feature 1..249: note = Synthetic polypeptide
  source 1..249: mol_type = other DNA

SEQ ID NO: 15513 - DNA, 316 bp, synthetic construct; identical to SEQ ID NO: 8692
  misc_feature 1..316: note = Synthetic polypeptide
  source 1..316: mol_type = other DNA

SEQ ID NO: 15514 - DNA, 387 bp, synthetic construct; identical to SEQ ID NO: 544
  misc_feature 1..387: note = Synthetic polypeptide
  source 1..387: mol_type = other DNA

SEQ ID NO: 15515 - DNA, 540 bp, synthetic construct; identical to SEQ ID NO: 545
  misc_feature 1..540: note = Synthetic polypeptide
  source 1..540: mol_type = other DNA

SEQ ID NO: 15516 - DNA, 303 bp, synthetic construct; identical to SEQ ID NO: 547
  misc_feature 1..303: note = Synthetic polypeptide
  source 1..303: mol_type = other DNA

SEQ ID NO: 15517 - DNA, 7988 bp, synthetic construct; identical to SEQ ID NO: 8551
  misc_feature 1..7988: note = Synthetic polypeptide
  source 1..7988: mol_type = other DNA

SEQ ID NO: 15518 - DNA, 1301 bp, synthetic construct; identical to SEQ ID NO: 8552
  misc_feature 1..1301: note = Synthetic polypeptide
  source 1..1301: mol_type = other DNA

SEQ ID NO: 15519 - DNA, 806 bp, synthetic construct; identical to SEQ ID NO: 8266
  misc_feature 1..806: note = Synthetic polypeptide
  source 1..806: mol_type = other DNA

SEQ ID NO: 15520 - DNA, 586 bp, synthetic construct; identical to SEQ ID NO: 6809
  misc_feature 1..586: note = Synthetic polypeptide
  source 1..586: mol_type = other DNA

SEQ ID NO: 15521 - DNA, 162 bp, synthetic construct; identical to SEQ ID NO: 13406
  misc_feature 1..162: note = Synthetic polypeptide
  source 1..162: mol_type = other DNA

SEQ ID NO: 15522 - DNA, 372 bp, synthetic construct; identical to SEQ ID NO: 13407
  misc_feature 1..372: note = Synthetic polypeptide
  source 1..372: mol_type = other DNA

SEQ ID NO: 15523 - DNA, 3162 bp, synthetic construct
  misc_feature 1..3162: note = Synthetic polypeptide
  source 1..3162: mol_type = other DNA
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggaggctgatggatgtgctgactagtgagagtgcttgggccctcccccagcacctagggaaaggcttcccctccccctccggccacaaggtccctgggtggcacgggaggatggactga

SEQ ID NO: 15524 - DNA, 3390 bp, synthetic construct
  misc_feature 1..3390: note = Synthetic polypeptide
  source 1..3390: mol_type = other DNA
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctag

SEQ ID NO: 15525 - DNA, 1359 bp, synthetic construct
  misc_feature 1..1359: note = Synthetic polypeptide
  source 1..1359: mol_type = other DNA
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaagacagaataa

SEQ ID NO: 15526 - DNA, 994 bp, synthetic construct
  misc_feature 1..994: note = Synthetic polypeptide
  source 1..994: mol_type = other DNA
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgg

SEQ ID NO: 15527 - DNA, 628 bp, synthetic construct; identical to SEQ ID NO: 8616
  misc_feature 1..628: note = Synthetic polypeptide
  source 1..628: mol_type = other DNA

SEQ ID NO: 15528 - DNA, 568 bp, synthetic construct; identical to SEQ ID NO: 6787
  misc_feature 1..568: note = Synthetic polypeptide
  source 1..568: mol_type = other DNA

SEQ ID NO: 15529 - DNA, 181 bp, synthetic construct; identical to SEQ ID NO: 6788
  misc_feature 1..181: note = Synthetic polypeptide
  source 1..181: mol_type = other DNA

SEQ ID NO: 15530 - DNA, 861 bp, synthetic construct; identical to SEQ ID NO: 604
  misc_feature 1..861: note = Synthetic polypeptide
  source 1..861: mol_type = other DNA

SEQ ID NO: 15531 - DNA, 2256 bp, synthetic construct; identical to SEQ ID NO: 8407
  misc_feature 1..2256: note = Synthetic polypeptide
  source 1..2256: mol_type = other DNA

SEQ ID NO: 15532 - DNA, 411 bp, synthetic construct; identical to SEQ ID NO: 6630
  misc_feature 1..411: note = Synthetic polypeptide
  source 1..411: mol_type = other DNA

SEQ ID NO: 15533 - DNA, 287 bp, synthetic construct; identical to SEQ ID NO: 7101
  misc_feature 1..287: note = Synthetic polypeptide
  source 1..287: mol_type = other DNA

SEQ ID NO: 15534 - DNA, 281 bp, synthetic construct; identical to SEQ ID NO: 7102
  misc_feature 1..281: note = Synthetic polypeptide
  source 1..281: mol_type = other DNA

SEQ ID NO: 15535 - DNA, 943 bp, synthetic construct; identical to SEQ ID NO: 6540
  misc_feature 1..943: note = Synthetic polypeptide
  source 1..943: mol_type = other DNA

SEQ ID NO: 15536 - DNA, 2786 bp, synthetic construct
  misc_feature 1..2786: note = Synthetic polypeptide
  source 1..2786: mol_type = other DNA
gctattgttagcgttttctagcaataaaatatttttaaattaagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttag

SEQ ID NO: 15537 - DNA, 347 bp, synthetic construct; identical to SEQ ID NO: 452
  misc_feature 1..347: note = Synthetic polypeptide
  source 1..347: mol_type = other DNA

SEQ ID NO: 15538 - DNA, 148 bp, synthetic construct; identical to SEQ ID NO: 454
  misc_feature 1..148: note = Synthetic polypeptide
  source 1..148: mol_type = other DNA

SEQ ID NO: 15539 - DNA, 127 bp, synthetic construct; identical to SEQ ID NO: 8697
  misc_feature 1..127: note = Synthetic polypeptide
  source 1..127: mol_type = other DNA

SEQ ID NO: 15540 - DNA, 870 bp, synthetic construct
  misc_feature 1..870: note = Synthetic polypeptide
  source 1..870: mol_type = other DNA
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctag

SEQ ID NO: 15541 - DNA, 715 bp, synthetic construct
  misc_feature 1..715: note = Synthetic polypeptide
  source 1..715: mol_type = other DNA
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcg

SEQ ID NO: 15542 - DNA, 516 bp, synthetic construct
  misc_feature 1..516: note = Synthetic polypeptide
  source 1..516: mol_type = other DNA
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgg

SEQ ID NO: 15543 - DNA, 809 bp, synthetic construct; identical to SEQ ID NO: 8699
  misc_feature 1..809: note = Synthetic polypeptide
  source 1..809: mol_type = other DNA

SEQ ID NO: 15544 - DNA, 962 bp, synthetic construct; identical to SEQ ID NO: 13039
  misc_feature 1..962: note = Synthetic polypeptide
  source 1..962: mol_type = other DNA

SEQ ID NO: 15545 - DNA, 986 bp, synthetic construct; identical to SEQ ID NO: 13040
  misc_feature 1..986: note = Synthetic polypeptide
  source 1..986: mol_type = other DNA

SEQ ID NO: 15546 - DNA, 399 bp, synthetic construct; identical to SEQ ID NO: 13041
  misc_feature 1..399: note = Synthetic polypeptide
  source 1..399: mol_type = other DNA

SEQ ID NO: 15547 - DNA, 203 bp, synthetic construct; identical to SEQ ID NO: 13042
  misc_feature 1..203: note = Synthetic polypeptide
  source 1..203: mol_type = other DNA

SEQ ID NO: 15548 - DNA, 186 bp, synthetic construct; identical to SEQ ID NO: 13043
  misc_feature 1..186: note = Synthetic polypeptide
  source 1..186: mol_type = other DNA

SEQ ID NO: 15549 - DNA, 122 bp, synthetic construct; identical to SEQ ID NO: 13044
  misc_feature 1..122: note = Synthetic polypeptide
  source 1..122: mol_type = other DNA

SEQ ID NO: 15550 - DNA, 809 bp, synthetic construct; identical to SEQ ID NO: 8505
  misc_feature 1..809: note = Synthetic polypeptide
  source 1..809: mol_type = other DNA

SEQ ID NO: 15551 - DNA, 809 bp, synthetic construct; identical to SEQ ID NO: 8506
  misc_feature 1..809: note = Synthetic polypeptide
  source 1..809: mol_type = other DNA

SEQ ID NO: 15552 - DNA, 1516 bp, synthetic construct; identical to SEQ ID NO: 534
  misc_feature 1..1516: note = Synthetic polypeptide
  source 1..1516: mol_type = other DNA

SEQ ID NO: 15553 - DNA, 591 bp, synthetic construct; identical to SEQ ID NO: 539
  misc_feature 1..591: note = Synthetic polypeptide
  source 1..591: mol_type = other DNA

SEQ ID NO: 15554 - DNA, 482 bp, synthetic construct; identical to SEQ ID NO: 540
  misc_feature 1..482: note = Synthetic polypeptide
  source 1..482: mol_type = other DNA

SEQ ID NO: 15555 - DNA, 444 bp, synthetic construct; identical to SEQ ID NO: 541
  misc_feature 1..444: note = Synthetic polypeptide
  source 1..444: mol_type = other DNA

SEQ ID NO: 15556 - DNA, 334 bp, synthetic construct; identical to SEQ ID NO: 533
  misc_feature 1..334: note = Synthetic polypeptide
  source 1..334: mol_type = other DNA

SEQ ID NO: 15557 - DNA, 38 bp, synthetic construct; identical to SEQ ID NO: 543
  misc_feature 1..38: note = Synthetic polypeptide
  source 1..38: mol_type = other DNA

SEQ ID NO: 15558 - DNA, 245 bp, synthetic construct; identical to SEQ ID NO: 542
  misc_feature 1..245: note = Synthetic polypeptide
  source 1..245: mol_type = other DNA

SEQ ID NO: 15559 - DNA, 809 bp, synthetic construct; identical to SEQ ID NO: 8699
  misc_feature 1..809: note = Synthetic polypeptide
  source 1..809: mol_type = other DNA

SEQ ID NO: 15560 - DNA, 328 bp, synthetic construct; identical to SEQ ID NO: 8517
  misc_feature 1..328: note = Synthetic polypeptide
  source 1..328: mol_type = other DNA

SEQ ID NO: 15561 - DNA, 1497 bp, synthetic construct; identical to SEQ ID NO: 8518
  misc_feature 1..1497: note = Synthetic polypeptide
  source 1..1497: mol_type = other DNA

SEQ ID NO: 15562 - DNA, 76 bp, synthetic construct; identical to SEQ ID NO: 8519
  misc_feature 1..76: note = Synthetic polypeptide
  source 1..76: mol_type = other DNA

SEQ ID NO: 15563 - DNA, 636 bp, synthetic construct; identical to SEQ ID NO: 817
  misc_feature 1..636: note = Synthetic polypeptide
  source 1..636: mol_type = other DNA

SEQ ID NO: 15564 - DNA, 582 bp, synthetic construct; identical to SEQ ID NO: 819
  misc_feature 1..582: note = Synthetic polypeptide
  source 1..582: mol_type = other DNA

SEQ ID NO: 15565 - DNA, 1319 bp, synthetic construct; identical to SEQ ID NO: 13416
  misc_feature 1..1319: note = Synthetic polypeptide
  source 1..1319: mol_type = other DNA

SEQ ID NO: 15566 - DNA, 1685 bp, synthetic construct; identical to SEQ ID NO: 13417
  misc_feature 1..1685: note = Synthetic polypeptide
  source 1..1685: mol_type = other DNA

SEQ ID NO: 15567 - DNA, 1535 bp, synthetic construct; identical to SEQ ID NO: 13418
  misc_feature 1..1535: note = Synthetic polypeptide
  source 1..1535: mol_type = other DNA

SEQ ID NO: 15568 - DNA, 281 bp, synthetic construct; identical to SEQ ID NO: 9447
  misc_feature 1..281: note = Synthetic polypeptide
  source 1..281: mol_type = other DNA

SEQ ID NO: 15569 - DNA, 990 bp, synthetic construct; identical to SEQ ID NO: 9448
  misc_feature 1..990: note = Synthetic polypeptide
  source 1..990: mol_type = other DNA

SEQ ID NO: 15570 - DNA, 338 bp, synthetic construct; identical to SEQ ID NO: 9449
  misc_feature 1..338: note = Synthetic polypeptide
  source 1..338: mol_type = other DNA

SEQ ID NO: 15571 - DNA, 367 bp, synthetic construct; identical to SEQ ID NO: 9450
  misc_feature 1..367: note = Synthetic polypeptide
  source 1..367: mol_type = other DNA

SEQ ID NO: 15572 - DNA, 197 bp, synthetic construct; identical to SEQ ID NO: 9451
  misc_feature 1..197: note = Synthetic polypeptide
  source 1..197: mol_type = other DNA

SEQ ID NO: 15573 - DNA, 813 bp, synthetic construct; identical to SEQ ID NO: 9452
  misc_feature 1..813: note = Synthetic polypeptide
  source 1..813: mol_type = other DNA

SEQ ID NO: 15574 - DNA, 583 bp, synthetic construct; identical to SEQ ID NO: 9453
  misc_feature 1..583: note = Synthetic polypeptide
  source 1..583: mol_type = other DNA

SEQ ID NO: 15575 - DNA, 795 bp, synthetic construct; identical to SEQ ID NO: 9454
  misc_feature 1..795: note = Synthetic polypeptide
  source 1..795: mol_type = other DNA

SEQ ID NO: 15576 - DNA, 588 bp, synthetic construct; identical to SEQ ID NO: 9455
  misc_feature 1..588: note = Synthetic polypeptide
  source 1..588: mol_type = other DNA

SEQ ID NO: 15577 - DNA, 379 bp, synthetic construct; identical to SEQ ID NO: 9456
  misc_feature 1..379: note = Synthetic polypeptide
  source 1..379: mol_type = other DNA

SEQ ID NO: 15578 - DNA, 226 bp, synthetic construct; identical to SEQ ID NO: 13220
  misc_feature 1..226: note = Synthetic polypeptide
  source 1..226: mol_type = other DNA

SEQ ID NO: 15579 - DNA, 129 bp, synthetic construct; identical to SEQ ID NO: 13221
  misc_feature 1..129: note = Synthetic polypeptide
  source 1..129: mol_type = other DNA

SEQ ID NO: 15580 - DNA, 655 bp, synthetic construct
  misc_feature 1..655: note = Synthetic polypeptide
  source 1..655: mol_type = other DNA
gggaaaagtgggctgtaatggagaatatcaaggcttggcagtcagactggcctggatttgaatcctgccacttacattgcttcatctcactgaggctcagtttcttccacggaccactaggttgattaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaa

SEQ ID NO: 15581 - DNA, 556 bp, synthetic construct
  misc_feature 1..556: note = Synthetic polypeptide
  source 1..556: mol_type = other DNA
gggaaaagtgggctgtaatggagaatatcaaggcttggcagtcagactggcctggatttgaatcctgccacttacattgcttcatctcactgaggctcagtttcttccacggaccactaggttgattaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttga

SEQ ID NO: 15582 - DNA, 1093 bp, synthetic construct; identical to SEQ ID NO: 7796
  misc_feature 1..1093: note = Synthetic polypeptide
  source 1..1093: mol_type = other DNA

SEQ ID NO: 15583 - DNA, 2636 bp, synthetic construct; identical to SEQ ID NO: 8432
  misc_feature 1..2636: note = Synthetic polypeptide
  source 1..2636: mol_type = other DNA

SEQ ID NO: 15584 - DNA, 3776 bp, synthetic construct; identical to SEQ ID NO: 8433
  misc_feature 1..3776: note = Synthetic polypeptide
  source 1..3776: mol_type = other DNA

SEQ ID NO: 15585 - DNA, 796 bp, synthetic construct; identical to SEQ ID NO: 8652
  misc_feature 1..796: note = Synthetic polypeptide
  source 1..796: mol_type = other DNA

SEQ ID NO: 15586 - DNA, 383 bp, synthetic construct; identical to SEQ ID NO: 8653
  misc_feature 1..383: note = Synthetic polypeptide
  source 1..383: mol_type = other DNA

SEQ ID NO: 15587 - DNA, 155 bp, synthetic construct; identical to SEQ ID NO: 8654
  misc_feature 1..155: note = Synthetic polypeptide
  source 1..155: mol_type = other DNA

SEQ ID NO: 15588 - DNA, 118 bp, synthetic construct; identical to SEQ ID NO: 8655
  misc_feature 1..118: note = Synthetic polypeptide
  source 1..118: mol_type = other DNA

SEQ ID NO: 15589 - DNA, 193 bp, synthetic construct; identical to SEQ ID NO: 8656
  misc_feature 1..193: note = Synthetic polypeptide
  source 1..193: mol_type = other DNA

SEQ ID NO: 15590 - DNA, 103 bp, synthetic construct; identical to SEQ ID NO: 8657
  misc_feature 1..103: note = Synthetic polypeptide
  source 1..103: mol_type = other DNA

SEQ ID NO: 15591 - DNA, 230 bp, synthetic construct; identical to SEQ ID NO: 8658
  misc_feature 1..230: note = Synthetic polypeptide
  source 1..230: mol_type = other DNA

SEQ ID NO: 15592 - DNA, 279 bp, synthetic construct; identical to SEQ ID NO: 8659
  misc_feature 1..279: note = Synthetic polypeptide
  source 1..279: mol_type = other DNA

SEQ ID NO: 15593 - DNA, 4550 bp, synthetic construct
  misc_feature 1..4550: note = Synthetic polypeptide
  source 1..4550: mol_type = other DNA
atagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 15594 - DNA, 3641 bp, synthetic construct
  misc_feature 1..3641: note = Synthetic polypeptide
  source 1..3641: mol_type = other DNA
atagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 15595 - DNA, 4230 bp, synthetic construct
  misc_feature 1..4230: note = Synthetic polypeptide
  source 1..4230: mol_type = other DNA
gcagtggctcacgcctataatcctaatattttaggaggctgagatgagaggatcactgaagaccagagtttgagaccagcctggccaacatagtgagaccctgcgtcttaaaaaaaaaaaaaaaaaaaaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctatagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtga

SEQ ID NO: 15596 - DNA, 1739 bp, synthetic construct; identical to SEQ ID NO: 13222
  misc_feature 1..1739: note = Synthetic polypeptide
  source 1..1739: mol_type = other DNA

SEQ ID NO: 15597 - DNA, 1392 bp, synthetic construct; identical to SEQ ID NO: 6782
  misc_feature 1..1392: note = Synthetic polypeptide
  source 1..1392: mol_type = other DNA

SEQ ID NO: 15598 - DNA, 933 bp, synthetic construct; identical to SEQ ID NO: 6783
  misc_feature 1..933: note = Synthetic polypeptide
  source 1..933: mol_type = other DNA

SEQ ID NO: 15599 - DNA, 981 bp, synthetic construct; identical to SEQ ID NO: 6784
  misc_feature 1..981: note = Synthetic polypeptide
  source 1..981: mol_type = other DNA

SEQ ID NO: 15600 - DNA, 379 bp, synthetic construct; identical to SEQ ID NO: 9067
  misc_feature 1..379: note = Synthetic polypeptide
  source 1..379: mol_type = other DNA

SEQ ID NO: 15601 - DNA, 401 bp, synthetic construct
  misc_feature 1..401: note = Synthetic polypeptide
  source 1..401: mol_type = other DNA
gagttaaacttctaattaatatatataattctgtatataaagtgcaccaaaaagatgtgttttatgagaaaaattataagaaaggcacaaatatgtgttatttattgagaaaaaggaataattttaaggttatttcaaatatggatttaggaaggaaacagaaacaacatccaaaggaaccagcaagtatgacagagagagagagacagagatgaagacagtcatgggaatgaagatgcatttttggccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactga

SEQ ID NO: 15602 - DNA, 306 bp, synthetic construct; identical to SEQ ID NO: 8575
  misc_feature 1..306: note = Synthetic polypeptide
  source 1..306: mol_type = other DNA

SEQ ID NO: 15603 - DNA, 784 bp, synthetic construct; identical to SEQ ID NO: 6798
  misc_feature 1..784: note = Synthetic polypeptide
  source 1..784: mol_type = other DNA

SEQ ID NO: 15604 - DNA, 118 bp, synthetic construct; identical to SEQ ID NO: 13255
  misc_feature 1..118: note = Synthetic polypeptide
  source 1..118: mol_type = other DNA

SEQ ID NO: 15605 - DNA, 625 bp, synthetic construct; identical to SEQ ID NO: 6804
  misc_feature 1..625: note = Synthetic polypeptide
  source 1..625: mol_type = other DNA

SEQ ID NO: 15606 - DNA, 598 bp, synthetic construct; identical to SEQ ID NO: 6805
  misc_feature 1..598: note = Synthetic polypeptide
  source 1..598: mol_type = other DNA

SEQ ID NO: 15607 - DNA, 1242 bp, synthetic construct; identical to SEQ ID NO: 13513
  misc_feature 1..1242: note = Synthetic polypeptide
  source 1..1242: mol_type = other DNA

SEQ ID NO: 15608 - DNA, 3134 bp, synthetic construct
  misc_feature 1..3134: note = Synthetic polypeptide
  source 1..3134: mol_type = other DNA
gaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 15609 - DNA, 3338 bp, synthetic construct
  misc_feature 1..3338: note = Synthetic polypeptide
  source 1..3338: mol_type = other DNA
gaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 15610 - DNA, 809 bp, synthetic construct; identical to SEQ ID NO: 8586
  misc_feature 1..809: note = Synthetic polypeptide
  source 1..809: mol_type = other DNA

SEQ ID NO: 15611 - DNA, 809 bp, synthetic construct; identical to SEQ ID NO: 8587
  misc_feature 1..809: note = Synthetic polypeptide
  source 1..809: mol_type = other DNA

SEQ ID NO: 15612 - DNA, 327 bp, synthetic construct; identical to SEQ ID NO: 13380
  misc_feature 1..327: note = Synthetic polypeptide
  source 1..327: mol_type = other DNA

SEQ ID NO: 15613 - DNA, 724 bp, synthetic construct; identical to SEQ ID NO: 8796
  misc_feature 1..724: note = Synthetic polypeptide
  source 1..724: mol_type = other DNA

SEQ ID NO: 15614 - DNA, 75 bp, synthetic construct; identical to SEQ ID NO: 8797
  misc_feature 1..75: note = Synthetic polypeptide
  source 1..75: mol_type = other DNA

SEQ ID NO: 15615 - DNA, 961 bp, synthetic construct; identical to SEQ ID NO: 6722
  misc_feature 1..961: note = Synthetic polypeptide
  source 1..961: mol_type = other DNA

SEQ ID NO: 15616 - DNA, 841 bp, synthetic construct
  misc_feature 1..841: note = Synthetic polypeptide
  source 1..841: mol_type = other DNA
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctag

SEQ ID NO: 15617 - DNA, 572 bp, synthetic construct
  misc_feature 1..572: note = Synthetic polypeptide
  source 1..572: mol_type = other DNA
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggacaaggtcccagaaccctgggtgccctgcagcctgggttcagtgcccggagcccgtcctacctgggaacaatgcgcggctgatcatgcccggcatgatgatcaggcccatggggagcatc

SEQ ID NO: 15618 - DNA, 809 bp, synthetic construct; identical to SEQ ID NO: 8613
  misc_feature 1..809: note = Synthetic polypeptide
  source 1..809: mol_type = other DNA

SEQ ID NO: 15619 - DNA, 895 bp, synthetic construct; identical to SEQ ID NO: 613
  misc_feature 1..895: note = Synthetic polypeptide
  source 1..895: mol_type = other DNA

SEQ ID NO: 15620 - DNA, 247 bp, synthetic construct; identical to SEQ ID NO: 614
  misc_feature 1..247: note = Synthetic polypeptide
  source 1..247: mol_type = other DNA

SEQ ID NO: 15621 - DNA, 551 bp, synthetic construct; identical to SEQ ID NO: 615
  misc_feature 1..551: note = Synthetic polypeptide
  source 1..551: mol_type = other DNA

SEQ ID NO: 15622 - DNA, 266 bp, synthetic construct; identical to SEQ ID NO: 12983
  misc_feature 1..266: note = Synthetic polypeptide
  source 1..266: mol_type = other DNA

SEQ ID NO: 15623 - DNA, 1530 bp, synthetic construct; identical to SEQ ID NO: 7238
  misc_feature 1..1530: note = Synthetic polypeptide
  source 1..1530: mol_type = other DNA

SEQ ID NO: 15624 - DNA, 369 bp, synthetic construct; identical to SEQ ID NO: 7239
  misc_feature 1..369: note = Synthetic polypeptide
  source 1..369: mol_type = other DNA

SEQ ID NO: 15625 - DNA, 342 bp, synthetic construct; identical to SEQ ID NO: 7240
  misc_feature 1..342: note = Synthetic polypeptide
  source 1..342: mol_type = other DNA

SEQ ID NO: 15626 - DNA, 1419 bp, synthetic construct; identical to SEQ ID NO: 7241
  misc_feature 1..1419: note = Synthetic polypeptide
  source 1..1419: mol_type = other DNA

SEQ ID NO: 15627 - DNA, 1732 bp, synthetic construct
  misc_feature 1..1732: note = Synthetic polypeptide
  source 1..1732: mol_type = other DNA
agggatccccaaccctcgggccatggactggtacgggttcgtggcctgttaagaacgagaccacacagcaggggtgagcaacaggtgaacaagtgaagcttcatctgtatttacagctgctctccattgcttgcattacccccagagctccgcctcctgtcagatcagcagtagcattctcacaggatcacaaaccctcttgcaaactgtgcatgtgagagatctaggttgcacactccttatgagaatctaaagcctaatgatctgtcactgtctctcatcacccctagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaa

SEQ ID NO: 15628 - DNA, 1596 bp, synthetic construct
  misc_feature 1..1596: note = Synthetic polypeptide
  source 1..1596: mol_type = other DNA
cctgcacatgtatcctggaacaataaaaaaaaaaaagaaagaaaatgtggtatatgtctaccatggaatactacacagccataaaaaaggatgggatcatgtcttttgcaccaacacggatggaactggaggccattatcctgagtaaaatagaaagtcaaataccacatgttctcacttataagtggaatctaaacagcagatacacaaagattggaataatggacagtggagactacaaaaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 15629 - DNA, 1773 bp, synthetic construct
  misc_feature 1..1773: note = Synthetic polypeptide
  source 1..1773: mol_type = other DNA
cctgcacatgtatcctggaacaataaaaaaaaaaaagaaagaaaatgtggtatatgtctaccatggaatactacacagccataaaaaaggatgggatcatgtcttttgcaccaacacggatggaactggaggccattatcctgagtaaaatagaaagtcaaataccacatgttctcacttataagtggaatctaaacagcagatacacaaagattggaataatggacagtggagactacaaaaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 15630 - DNA, 578 bp, synthetic construct; identical to SEQ ID NO: 9000
  misc_feature 1..578: note = Synthetic polypeptide
  source 1..578: mol_type = other DNA

SEQ ID NO: 15631 - DNA, 590 bp, synthetic construct; identical to SEQ ID NO: 9001
  misc_feature 1..590: note = Synthetic polypeptide
  source 1..590: mol_type = other DNA

SEQ ID NO: 15632 - DNA, 130 bp, synthetic construct; identical to SEQ ID NO: 9002
  misc_feature 1..130: note = Synthetic polypeptide
  source 1..130: mol_type = other DNA

SEQ ID NO: 15633 - DNA, 1770 bp, synthetic construct
  misc_feature 1..1770: note = Synthetic polypeptide
  source 1..1770: mol_type = other DNA
tcagatgttggataatgatattgtagtttttaaaatggctttgttgtttgcagatacatactgaaatgtggatgaagtgataggtcaggaatttgcttcaaggatctgggagaggcagaagcatagatatgaatggctgctagttgatcattgaatctggatgagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataa

SEQ ID NO: 15634 - DNA, 720 bp, synthetic construct
  misc_feature 1..720: note = Synthetic polypeptide
  source 1..720: mol_type = other DNA
tcagatgttggataatgatattgtagtttttaaaatggctttgttgtttgcagatacatactgaaatgtggatgaagtgataggtcaggaatttgcttcaaggatctgggagaggcagaagcatagatatgaatggctgctagttgatcattgaatctggatgagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacagtctgggcactgggaaacatag

SEQ ID NO: 15635 - DNA, 177 bp, synthetic construct
  misc_feature 1..177: note = Synthetic polypeptide
  source 1..177: mol_type = other DNA
ggccgggtgcggaggctcacacctgtaatcccagcactttgggaggctgaggcaggcggatcacttgagctagaggaaatgacagagcttgaatctcctaaatgtaaaaggcaggaaaatgagcagctactggatcaaaatcaagaaatccgggcatcacagagaagttgggtttag

SEQ ID NO: 15636 - DNA, 398 bp, synthetic construct; identical to SEQ ID NO: 6790
  misc_feature 1..398: note = Synthetic polypeptide
  source 1..398: mol_type = other DNA

SEQ ID NO: 15637 - DNA, 391 bp, synthetic construct; identical to SEQ ID NO: 6791
  misc_feature 1..391: note = Synthetic polypeptide
  source 1..391: mol_type = other DNA

SEQ ID NO: 15638 - DNA, 473 bp, synthetic construct; identical to SEQ ID NO: 6792
  misc_feature 1..473: note = Synthetic polypeptide
  source 1..473: mol_type = other DNA

SEQ ID NO: 15639 - DNA, 585 bp, synthetic construct; identical to SEQ ID NO: 7806
  misc_feature 1..585: note = Synthetic polypeptide
  source 1..585: mol_type = other DNA

SEQ ID NO: 15640 - DNA, 1443 bp, synthetic construct; identical to SEQ ID NO: 6760
  misc_feature 1..1443: note = Synthetic polypeptide
  source 1..1443: mol_type = other DNA

SEQ ID NO: 15641 - DNA, 984 bp, synthetic construct; identical to SEQ ID NO: 6761
  misc_feature 1..984: note = Synthetic polypeptide
  source 1..984: mol_type = other DNA

SEQ ID NO: 15642 - DNA, 1032 bp, synthetic construct; identical to SEQ ID NO: 6762
  misc_feature 1..1032: note = Synthetic polypeptide
  source 1..1032: mol_type = other DNA

SEQ ID NO: 15643 - DNA, 676 bp, synthetic construct
  misc_feature 1..676: note = Synthetic polypeptide
  source 1..676: mol_type = other DNA
aatggaaacaaaaatgtaaacagtagttgataaaagaatagtatcaattaaaaacatactgtgaagtattcaacttcaccagtgatttaaaatagaaatgaaagcaaaataatattttctacagcggagcaaataaaatgaaagataatacataatgttggtgaggacatttttaaagggacacccatatattgcactggtatgtagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaat

SEQ ID NO: 15644 - DNA, 4725 bp, synthetic construct
  misc_feature 1..4725: note = Synthetic polypeptide
  source 1..4725: mol_type = other DNA
aatggaaacaaaaatgtaaacagtagttgataaaagaatagtatcaattaaaaacatactgtgaagtattcaacttcaccagtgatttaaaatagaaatgaaagcaaaataatattttctacagcggagcaaataaaatgaaagataatacataatgttggtgaggacatttttaaagggacacccatatattgcactggtatgtagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatag

SEQ ID NO: 15645 - DNA, 14950 bp, synthetic construct
  misc_feature 1..14950: note = Synthetic polypeptide
  source 1..14950: mol_type = other DNA
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatag

SEQ ID NO: 15646 - DNA, 3979 bp, synthetic construct
  misc_feature 1..3979: note = Synthetic polypeptide
  source 1..3979: mol_type = other DNA
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatga

SEQ ID NO: 15647 - DNA, 2518 bp, synthetic construct
  misc_feature 1..2518: note = Synthetic polypeptide
  source 1..2518: mol_type = other DNA
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctag

SEQ ID NO: 15648 - DNA, 1352 bp, synthetic construct; identical to SEQ ID NO: 8674
  misc_feature 1..1352: note = Synthetic polypeptide
  source 1..1352: mol_type = other DNA

SEQ ID NO: 15649 - DNA, 1147 bp, synthetic construct
  misc_feature 1..1147: note = Synthetic polypeptide
  source 1..1147: mol_type = other DNA
ggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtga

SEQ ID NO: 15650 - DNA, 526 bp, synthetic construct; identical to SEQ ID NO: 10237
  misc_feature 1..526: note = Synthetic polypeptide
  source 1..526: mol_type = other DNA

SEQ ID NO: 15651 - DNA, 1314 bp, synthetic construct; identical to SEQ ID NO: 10238
  misc_feature 1..1314: note = Synthetic polypeptide
  source 1..1314: mol_type = other DNA

SEQ ID NO: 15652 - DNA, 1218 bp, synthetic construct; identical to SEQ ID NO: 10239
  misc_feature 1..1218: note = Synthetic polypeptide
  source 1..1218: mol_type = other DNA

SEQ ID NO: 15653 - DNA, 1197 bp, synthetic construct; identical to SEQ ID NO: 10240
  misc_feature 1..1197: note = Synthetic polypeptide
  source 1..1197: mol_type = other DNA

SEQ ID NO: 15654 - DNA, 919 bp, synthetic construct; identical to SEQ ID NO: 10241
  misc_feature 1..919: note = Synthetic polypeptide
  source 1..919: mol_type = other DNA

SEQ ID NO: 15655 - DNA, 629 bp, synthetic construct; identical to SEQ ID NO: 10242
  misc_feature 1..629: note = Synthetic polypeptide
  source 1..629: mol_type = other DNA

SEQ ID NO: 15656 - DNA, 4170 bp, synthetic construct
  misc_feature 1..4170: note = Synthetic polypeptide
  source 1..4170: mol_type = other DNA
ctaacaattgctgtctgcggttagactccagtcagtcctggctttggaaagcttcctcccgtctatacaacgaagaggtcggaccagcgctaaggtcatccagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaa

SEQ ID NO: 15657 - DNA, 74 bp, synthetic construct; identical to SEQ ID NO: 7010
  misc_feature 1..74: note = Synthetic polypeptide
  source 1..74: mol_type = other DNA

SEQ ID NO: 15658 - DNA, 1488 bp, synthetic construct
  misc_feature 1..1488: note = Synthetic polypeptide
  source 1..1488: mol_type = other DNA
gaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtga

SEQ ID NO: 15659 - DNA, 1305 bp, synthetic construct
  misc_feature 1..1305: note = Synthetic polypeptide
  source 1..1305: mol_type = other DNA
gaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtga

SEQ ID NO: 15660 - DNA, 1446 bp, synthetic construct; identical to SEQ ID NO: 8572
  misc_feature 1..1446: note = Synthetic polypeptide
  source 1..1446: mol_type = other DNA

SEQ ID NO: 15661 - DNA, 104 bp, synthetic construct; identical to SEQ ID NO: 8573
  misc_feature 1..104: note = Synthetic polypeptide
  source 1..104: mol_type = other DNA

SEQ ID NO: 15662 - DNA, 489 bp, synthetic construct; identical to SEQ ID NO: 8574
  misc_feature 1..489: note = Synthetic polypeptide
  source 1..489: mol_type = other DNA

SEQ ID NO: 15663 - DNA, 294 bp, synthetic construct; identical to SEQ ID NO: 13689
  misc_feature 1..294: note = Synthetic polypeptide
  source 1..294: mol_type = other DNA

SEQ ID NO: 15664 - DNA, 104 bp, synthetic construct; identical to SEQ ID NO: 13690
  misc_feature 1..104: note = Synthetic polypeptide
  source 1..104: mol_type = other DNA

SEQ ID NO: 15665 - DNA, 750 bp, synthetic construct
  misc_feature 1..750: note = Synthetic polypeptide
  source 1..750: mol_type = other DNA
ccgagcgcagtggctcacacctgtaatcccagaactttgggaggccgagatacatcagcccacagcaaggcgggctccagcagcccggagccatgggcccggccctcctgcactccccaggaagggggctgcccacggcccaaggagcgtgagtcaccacccccttcggccctgcagccggtccagctgcctcgcctggccttgtctccaccacccccagcccctccactgccacccccaccgccactggcccaagtggcaccctcaccccctagccccccaccccctcctcggcctccacccacgctctcggcctcagacccctccctggacttcctgcgggcccagcaggagactgccaacgccatccgggagctggccggcacccttcgacagggactggccaaactgagcgaggccctcagcgctctgctgccccttctgccaggaaccccagttgactccctgcctccacctctgcccccacccccacccccaccgccacctcccaggcctgtcctgcccccaccggcccccaaggtggagatcaccccagagcccgtgtccgtggtggctgctgtggtggacggggcagtggtggcagccaggggagtgatcattgccccaaggagcgaggagggggcaccccggccccccccagccccgctccctccgcacgactcccccccacacaagcggagaaaaggtttccctacacggaaaaggcgcggccgatggaaatctccgtga

SEQ ID NO: 15666 - DNA, 2506 bp, synthetic construct
  misc_feature 1..2506: note = Synthetic polypeptide
  source 1..2506: mol_type = other DNA
gagacagcctcattcagacaagctctggagttggtcaaagcttggttcaaatcctgactccaccacttattaacgagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataa

SEQ ID NO: 15667 - DNA, 1027 bp, synthetic construct
  misc_feature 1..1027: note = Synthetic polypeptide
  source 1..1027: mol_type = other DNA
gagacagcctcattcagacaagctctggagttggtcaaagcttggttcaaatcctgactccaccacttattaacgagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtga

SEQ ID NO: 15668 - DNA, 242 bp, synthetic construct
  misc_feature 1..242: note = Synthetic polypeptide
  source 1..242: mol_type = other DNA
ggccgggcgcggtggctcatgcctgtaatcccagcactttgggaggctgaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaa

SEQ ID NO: 15669 - DNA, 172 bp, synthetic construct
  misc_feature 1..172: note = Synthetic polypeptide
  source 1..172: mol_type = other DNA
ggccgggcgcggtggctcatgcctgtaatcccagcactttgggaggctgaggtcagtttgctgagaacgaaaccaatgaggtcaattttagagagataccttcacatgtgctatcgaaagtatgcatgtattttacgtacaaggttcgctacactaacagctccaccgagat

SEQ ID NO: 15670 - DNA, 2534 bp, synthetic construct; identical to SEQ ID NO: 586
  misc_feature 1..2534: note = Synthetic polypeptide
  source 1..2534: mol_type = other DNA

SEQ ID NO: 15671 - DNA, 342 bp, synthetic construct
  misc_feature 1..342: note = Synthetic polypeptide
  source 1..342: mol_type = other DNA
aagatggccaaacaggaacagctccagtctacagctcccagcgtgagcaacacagaagacgaatgatttctgcatttccaactgaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 15672 - DNA, 519 bp, synthetic construct; identical to SEQ ID NO: 9679
  misc_feature 1..519: note = Synthetic polypeptide
  source 1..519: mol_type = other DNA

SEQ ID NO: 15673 - DNA, 213 bp, synthetic construct; identical to SEQ ID NO: 9680
  misc_feature 1..213: note = Synthetic polypeptide
  source 1..213: mol_type = other DNA

SEQ ID NO: 15674 - DNA, 117 bp, synthetic construct; identical to SEQ ID NO: 13730
  misc_feature 1..117: note = Synthetic polypeptide
  source 1..117: mol_type = other DNA

SEQ ID NO: 15675 - DNA, 1968 bp, synthetic construct
  misc_feature 1..1968: note = Synthetic polypeptide
  source 1..1968: mol_type = other DNA
aatagagctccaagaggcagaagtttgtatcaattatgttccttgcttgttgctgagaatctagaacggtgttaattagcacatggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaa

SEQ ID NO: 15676 - DNA, 1331 bp, synthetic construct; identical to SEQ ID NO: 550
  misc_feature 1..1331: note = Synthetic polypeptide
  source 1..1331: mol_type = other DNA

SEQ ID NO: 15677 - DNA, 1028 bp, synthetic construct; identical to SEQ ID NO: 551
  misc_feature 1..1028: note = Synthetic polypeptide
  source 1..1028: mol_type = other DNA

SEQ ID NO: 15678 - DNA, 1295 bp, synthetic construct; identical to SEQ ID NO: 553
  misc_feature 1..1295: note = Synthetic polypeptide
  source 1..1295: mol_type = other DNA

SEQ ID NO: 15679 - DNA, 1322 bp, synthetic construct; identical to SEQ ID NO: 554
  misc_feature 1..1322: note = Synthetic polypeptide
  source 1..1322: mol_type = other DNA

SEQ ID NO: 15680 - DNA, 1013 bp, synthetic construct; identical to SEQ ID NO: 555
  misc_feature 1..1013: note = Synthetic polypeptide
  source 1..1013: mol_type = other DNA

SEQ ID NO: 15681 - DNA, 1272 bp, synthetic construct
  misc_feature 1..1272: note = Synthetic polypeptide
  source 1..1272: mol_type = other DNA
ggctggtcgtggtggttcatgcctgtaatcccagcactttgggaggctgaggcggtggatcacttgaacccaggagttcaagaccagcctggccaacatggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttga

SEQ ID NO: 15682 - DNA, 1080 bp, synthetic construct
  misc_feature 1..1080: note = Synthetic polypeptide
  source 1..1080: mol_type = other DNA
ggctggtcgtggtggttcatgcctgtaatcccagcactttgggaggctgaggcggtggatcacttgaacccaggagttcaagaccagcctggccaacatggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttga

SEQ ID NO: 15683 - DNA, 139 bp, synthetic construct; identical to SEQ ID NO: 13085
  misc_feature 1..139: note = Synthetic polypeptide
  source 1..139: mol_type = other DNA

SEQ ID NO: 15684 - DNA, 511 bp, synthetic construct
  misc_feature 1..511: note = Synthetic polypeptide
  source 1..511: mol_type = other DNA
ggaggaggcggtggaggaagaggtggcggcggtggcggtggtcgtagcggtggcggaggaggcgggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 15685 - DNA, 278 bp, synthetic construct
  misc_feature 1..278: note = Synthetic polypeptide
  source 1..278: mol_type = other DNA
ggaggaggcggtggaggaagaggtggcggcggtggcggtggtcgtagcggtggcggaggaggcgggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtctt

SEQ ID NO: 15686 - DNA, 328 bp, synthetic construct
  misc_feature 1..328: note = Synthetic polypeptide
  source 1..328: mol_type = other DNA
ggaggaggcggtggaggaagaggtggcggcggtggcggtggtcgtagcggtggcggaggaggcgggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 15687 - DNA, 382 bp, synthetic construct
  misc_feature 1..382: note = Synthetic polypeptide
  source 1..382: mol_type = other DNA
ggaggaggcggtggaggaagaggtggcggcggtggcggtggtcgtagcggtggcggaggaggcgggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactga

SEQ ID NO: 15688 - DNA, 2317 bp, synthetic construct; identical to SEQ ID NO: 8404
  misc_feature 1..2317: note = Synthetic polypeptide
  source 1..2317: mol_type = other DNA

SEQ ID NO: 15689 - DNA, 597 bp, synthetic construct; identical to SEQ ID NO: 759
  misc_feature 1..597: note = Synthetic polypeptide
  source 1..597: mol_type = other DNA

SEQ ID NO: 15690 - DNA, 654 bp, synthetic construct; identical to SEQ ID NO: 760
  misc_feature 1..654: note = Synthetic polypeptide
  source 1..654: mol_type = other DNA

SEQ ID NO: 15691 - DNA, 654 bp, synthetic construct; identical to SEQ ID NO: 6998
  misc_feature 1..654: note = Synthetic polypeptide
  source 1..654: mol_type = other DNA

SEQ ID NO: 15692 - DNA, 651 bp, synthetic construct; identical to SEQ ID NO: 6999
  misc_feature 1..651: note = Synthetic polypeptide
  source 1..651: mol_type = other DNA

SEQ ID NO: 15693 - DNA, 498 bp, synthetic construct; identical to SEQ ID NO: 7000
  misc_feature 1..498: note = Synthetic polypeptide
  source 1..498: mol_type = other DNA

SEQ ID NO: 15694 - DNA, 189 bp, synthetic construct; identical to SEQ ID NO: 7001
  misc_feature 1..189: note = Synthetic polypeptide
  source 1..189: mol_type = other DNA

SEQ ID NO: 15695 - DNA, 718 bp, synthetic construct; identical to SEQ ID NO: 821
  misc_feature 1..718: note = Synthetic polypeptide
  source 1..718: mol_type = other DNA

SEQ ID NO: 15696 - DNA, 112 bp, synthetic construct; identical to SEQ ID NO: 7120
  misc_feature 1..112: note = Synthetic polypeptide
  source 1..112: mol_type = other DNA

SEQ ID NO: 15697 - DNA, 1034 bp, synthetic construct
  misc_feature 1..1034: note = Synthetic polypeptide
  source 1..1034: mol_type = other DNA
gccggttgcggtggctctcacctgtaatcccagcactttgagaggctgagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttga

SEQ ID NO: 15698 - DNA, 482 bp, synthetic construct
  misc_feature 1..482: note = Synthetic polypeptide
  source 1..482: mol_type = other DNA
gccggttgcggtggctctcacctgtaatcccagcactttgagaggctgagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttg

SEQ ID NO: 15699 - DNA, 1151 bp, synthetic construct; identical to SEQ ID NO: 13468
  misc_feature 1..1151: note = Synthetic polypeptide
  source 1..1151: mol_type = other DNA

SEQ ID NO: 15700 - DNA, 516 bp, synthetic construct; identical to SEQ ID NO: 13469
  misc_feature 1..516: note = Synthetic polypeptide
  source 1..516: mol_type = other DNA

SEQ ID NO: 15701 - DNA, 353 bp, synthetic construct; identical to SEQ ID NO: 13470
  misc_feature 1..353: note = Synthetic polypeptide
  source 1..353: mol_type = other DNA

SEQ ID NO: 15702 - DNA, 1679 bp, synthetic construct; identical to SEQ ID NO: 13471
  misc_feature 1..1679: note = Synthetic polypeptide
  source 1..1679: mol_type = other DNA

SEQ ID NO: 15703 - DNA, 1916 bp, synthetic construct; identical to SEQ ID NO: 13472
  misc_feature 1..1916: note = Synthetic polypeptide
  source 1..1916: mol_type = other DNA

SEQ ID NO: 15704 - DNA, 720 bp, synthetic construct; identical to SEQ ID NO: 7789
  misc_feature 1..720: note = Synthetic polypeptide
  source 1..720: mol_type = other DNA

SEQ ID NO: 15705 - DNA, 3133 bp, synthetic construct; identical to SEQ ID NO: 7183
  misc_feature 1..3133: note = Synthetic polypeptide
  source 1..3133: mol_type = other DNA

SEQ ID NO: 15706 - DNA, 369 bp, synthetic construct; identical to SEQ ID NO: 13247
  misc_feature 1..369: note = Synthetic polypeptide
  source 1..369: mol_type = other DNA

SEQ ID NO: 15707 - DNA, 1864 bp, synthetic construct
  misc_feature 1..1864: note = Synthetic polypeptide
  source 1..1864: mol_type = other DNA
gtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaa

SEQ ID NO: 15708 - DNA, 1067 bp, synthetic construct; identical to SEQ ID NO: 9936
  misc_feature 1..1067: note = Synthetic polypeptide
  source 1..1067: mol_type = other DNA

SEQ ID NO: 15709 - DNA, 968 bp, synthetic construct; identical to SEQ ID NO: 9937
  misc_feature 1..968: note = Synthetic polypeptide
  source 1..968: mol_type = other DNA

SEQ ID NO: 15710 - DNA, 7615 bp, synthetic construct
  misc_feature 1..7615: note = Synthetic polypeptide
  source 1..7615: mol_type = other DNA
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 15711 - DNA, 7606 bp, synthetic construct
  misc_feature 1..7606: note = Synthetic polypeptide
  source 1..7606: mol_type = other DNA
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 15712 - DNA, 487 bp, synthetic construct
  misc_feature 1..487: note = Synthetic polypeptide
  source 1..487: mol_type = other DNA
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgatagattcccagaagtggaattgcttggtcaaacgccctgtgtgtccaaatgctgggagaacatcaccccttggatga

SEQ ID NO: 15713 - DNA, 451 bp, synthetic construct
  misc_feature 1..451: note = Synthetic polypeptide
  source 1..451: mol_type = other DNA
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttccctgtgtgtccaaatgctgggagaacatcaccccttggatga

SEQ ID NO: 15714 - DNA, 852 bp, synthetic construct; identical to SEQ ID NO: 753
  misc_feature 1..852: note = Synthetic polypeptide
  source 1..852: mol_type = other DNA

SEQ ID NO: 15715 - DNA, 311 bp, synthetic construct; identical to SEQ ID NO: 13308
  misc_feature 1..311: note = Synthetic polypeptide
  source 1..311: mol_type = other DNA

SEQ ID NO: 15716 - DNA, 1317 bp, synthetic construct; identical to SEQ ID NO: 7058
  misc_feature 1..1317: note = Synthetic polypeptide
  source 1..1317: mol_type = other DNA

SEQ ID NO: 15717 - DNA, 2624 bp, synthetic construct
  misc_feature 1..2624: note = Synthetic polypeptide
  source 1..2624: mol_type = other DNA
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15718 - DNA, 1454 bp, synthetic construct
  misc_feature 1..1454: note = Synthetic polypeptide
  source 1..1454: mol_type = other DNA
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggttcacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15719 - DNA, 197 bp, synthetic construct
  misc_feature 1..197: note = Synthetic polypeptide
  source 1..197: mol_type = other DNA
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggtcatatcagaggagctgagttggcagaccgggcccccctga

SEQ ID NO: 15720 - DNA, 1083 bp, synthetic construct; identical to SEQ ID NO: 7080
  misc_feature 1..1083: note = Synthetic polypeptide
  source 1..1083: mol_type = other DNA

SEQ ID NO: 15721 - DNA, 888 bp, synthetic construct; identical to SEQ ID NO: 9660
  misc_feature 1..888: note = Synthetic polypeptide
  source 1..888: mol_type = other DNA

SEQ ID NO: 15722 - DNA, 1254 bp, synthetic construct; identical to SEQ ID NO: 9661
  misc_feature 1..1254: note = Synthetic polypeptide
  source 1..1254: mol_type = other DNA

SEQ ID NO: 15723 - DNA, 1104 bp, synthetic construct; identical to SEQ ID NO: 9662
  misc_feature 1..1104: note = Synthetic polypeptide
  source 1..1104: mol_type = other DNA

SEQ ID NO: 15724 - DNA, 215 bp, synthetic construct; identical to SEQ ID NO: 13496
  misc_feature 1..215: note = Synthetic polypeptide
  source 1..215: mol_type = other DNA

SEQ ID NO: 15725 - DNA, 441 bp, synthetic construct; identical to SEQ ID NO: 13497
  misc_feature 1..441: note = Synthetic polypeptide
  source 1..441: mol_type = other DNA

SEQ ID NO: 15726 - DNA, 444 bp, synthetic construct; identical to SEQ ID NO: 13498
  misc_feature 1..444: note = Synthetic polypeptide
  source 1..444: mol_type = other DNA

SEQ ID NO: 15727 - DNA, 432 bp, synthetic construct; identical to SEQ ID NO: 13499
  misc_feature 1..432: note = Synthetic polypeptide
  source 1..432: mol_type = other DNA

SEQ ID NO: 15728 - DNA, 809 bp, synthetic construct; identical to SEQ ID NO: 8613
  misc_feature 1..809: note = Synthetic polypeptide
  source 1..809: mol_type = other DNA

SEQ ID NO: 15729 - DNA, 2595 bp, synthetic construct
  misc_feature 1..2595: note = Synthetic polypeptide
  source 1..2595: mol_type = other DNA
gcggttaagactgtgactccagaatcaagatcctgagcttgaaggtggtctctgccacgcaccagctgtgggccttgggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactag

SEQ ID NO: 15730 - DNA, 1284 bp, synthetic construct; identical to SEQ ID NO: 648
  misc_feature 1..1284: note = Synthetic polypeptide
  source 1..1284: mol_type = other DNA

SEQ ID NO: 15731 - DNA, 1077 bp, synthetic construct; identical to SEQ ID NO: 649
  misc_feature 1..1077: note = Synthetic polypeptide
  source 1..1077: mol_type = other DNA

SEQ ID NO: 15732 - DNA, 972 bp, synthetic construct; identical to SEQ ID NO: 650
  misc_feature 1..972: note = Synthetic polypeptide
  source 1..972: mol_type = other DNA

SEQ ID NO: 15733 - DNA, 1617 bp, synthetic construct
  misc_feature 1..1617: note = Synthetic polypeptide
  source 1..1617: mol_type = other DNA
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaa

SEQ ID NO: 15734 - DNA, 399 bp, synthetic construct
  misc_feature 1..399: note = Synthetic polypeptide
  source 1..399: mol_type = other DNA
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagactga

SEQ ID NO: 15735 - DNA, 450 bp, synthetic construct
  misc_feature 1..450: note = Synthetic polypeptide
  source 1..450: mol_type = other DNA
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactga

SEQ ID NO: 15736 - DNA, 1498 bp, synthetic construct
  misc_feature 1..1498: note = Synthetic polypeptide
  source 1..1498: mol_type = other DNA
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatga

SEQ ID NO: 15737 - DNA, 659 bp, synthetic construct
  misc_feature 1..659: note = Synthetic polypeptide
  source 1..659: mol_type = other DNA
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaag

SEQ ID NO: 15738 - DNA, 619 bp, synthetic construct
  misc_feature 1..619: note = Synthetic polypeptide
  source 1..619: mol_type = other DNA
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagattaaaagaagctgtgcattttcactgttttcttttttcatctag

SEQ ID NO: 15739 - DNA, 543 bp, synthetic construct
  misc_feature 1..543: note = Synthetic polypeptide
  source 1..543: mol_type = other DNA
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgta

SEQ ID NO: 15740 - DNA, 1912 bp, synthetic construct; identical to SEQ ID NO: 8999
  misc_feature 1..1912: note = Synthetic polypeptide
  source 1..1912: mol_type = other DNA

SEQ ID NO: 15741 - DNA, 999 bp, synthetic construct; identical to SEQ ID NO: 7471
  misc_feature 1..999: note = Synthetic polypeptide
  source 1..999: mol_type = other DNA

SEQ ID NO: 15742 - DNA, 3220 bp, synthetic construct; identical to SEQ ID NO: 8585
  misc_feature 1..3220: note = Synthetic polypeptide
  source 1..3220: mol_type = other DNA

SEQ ID NO: 15743 - DNA, 835 bp, synthetic construct
  misc_feature 1..835: note = Synthetic polypeptide
  source 1..835: mol_type = other DNA
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctga

SEQ ID NO: 15744 - DNA, 787 bp, synthetic construct
  misc_feature 1..787: note = Synthetic polypeptide
  source 1..787: mol_type = other DNA
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctga

SEQ ID NO: 15745 - DNA, 594 bp, synthetic construct
  misc_feature 1..594: note = Synthetic polypeptide
  source 1..594: mol_type = other DNA
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtga

SEQ ID NO: 15746 - DNA, 1218 bp, synthetic construct; identical to SEQ ID NO: 654
  misc_feature 1..1218: note = Synthetic polypeptide
  source 1..1218: mol_type = other DNA

SEQ ID NO: 15747 - DNA, 255 bp, synthetic construct
  misc_feature 1..255: note = Synthetic polypeptide
  source 1..255: mol_type = other DNA
gactgggcgcagtggctcacgcctgtgatcccagcactttgggagggtgagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatag

SEQ ID NO: 15748 - DNA, 211 bp, synthetic construct
  misc_feature 1..211: note = Synthetic polypeptide
  source 1..211: mol_type = other DNA
gactgggcgcagtggctcacgcctgtgatcccagcactttgggagggtgagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctata

SEQ ID NO: 15749 - DNA, 503 bp, synthetic construct; identical to SEQ ID NO: 493
  misc_feature 1..503: note = Synthetic polypeptide
  source 1..503: mol_type = other DNA

SEQ ID NO: 15750 - DNA, 476 bp, synthetic construct; identical to SEQ ID NO: 495
  misc_feature 1..476: note = Synthetic polypeptide
  source 1..476: mol_type = other DNA

SEQ ID NO: 15751 - DNA, 539 bp, synthetic construct; identical to SEQ ID NO: 496
  misc_feature 1..539: note = Synthetic polypeptide
  source 1..539: mol_type = other DNA

SEQ ID NO: 15752 - DNA, 1790 bp, synthetic construct; identical to SEQ ID NO: 8350
  misc_feature 1..1790: note = Synthetic polypeptide
  source 1..1790: mol_type = other DNA

SEQ ID NO: 15753 - DNA, 645 bp, synthetic construct
  misc_feature 1..645: note = Synthetic polypeptide
  source 1..645: mol_type = other DNA
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctga

SEQ ID NO: 15754 - DNA, 468 bp, synthetic construct
  misc_feature 1..468: note = Synthetic polypeptide
  source 1..468: mol_type = other DNA
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtg

SEQ ID NO: 15755 - DNA, 201 bp, synthetic construct
  misc_feature 1..201: note = Synthetic polypeptide
  source 1..201: mol_type = other DNA
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgagtctgcggctatcctc

SEQ ID NO: 15756 - DNA, 112 bp, synthetic construct
  misc_feature 1..112: note = Synthetic polypeptide
  source 1..112: mol_type = other DNA
cccaaaggtattgacctgatggacatggcttcggacatcctgcagcccaaaggagatgatgtggcccggatcagctggtacctccgtgacatcatcactcgataccaggaga

SEQ ID NO: 15757 - DNA, 1234 bp, synthetic construct; identical to SEQ ID NO: 13601
  misc_feature 1..1234: note = Synthetic polypeptide
  source 1..1234: mol_type = other DNA

SEQ ID NO: 15758 - DNA, 981 bp, synthetic construct; identical to SEQ ID NO: 12548
  misc_feature 1..981: note = Synthetic polypeptide
  source 1..981: mol_type = other DNA

SEQ ID NO: 15759 - DNA, 4908 bp, synthetic construct; identical to SEQ ID NO: 11516
  misc_feature 1..4908: note = Synthetic polypeptide
  source 1..4908: mol_type = other DNA

SEQ ID NO: 15760 - DNA, 4611 bp, synthetic construct; identical to SEQ ID NO: 11517
  misc_feature 1..4611: note = Synthetic polypeptide
  source 1..4611: mol_type = other DNA

SEQ ID NO: 15761 - DNA, 5142 bp, synthetic construct; identical to SEQ ID NO: 11518
  misc_feature 1..5142: note = Synthetic polypeptide
  source 1..5142: mol_type = other DNA

SEQ ID NO: 15762 - DNA, 777 bp, synthetic construct; identical to SEQ ID NO: 11519
  misc_feature 1..777: note = Synthetic polypeptide
  source 1..777: mol_type = other DNA

SEQ ID NO: 15763 - DNA, 191 bp, synthetic construct; identical to SEQ ID NO: 6971
  misc_feature 1..191: note = Synthetic polypeptide
  source 1..191: mol_type = other DNA

SEQ ID NO: 15764 - DNA, 194 bp, synthetic construct; identical to SEQ ID NO: 6972
  misc_feature 1..194: note = Synthetic polypeptide
  source 1..194: mol_type = other DNA

SEQ ID NO: 15765 - DNA, 424 bp, synthetic construct
  misc_feature 1..424: note = Synthetic polypeptide
  source 1..424: mol_type = other DNA
gaccaggcgcggcggctcacgcctgtgatcccagcactgggaggccgaggcaggcggatcactggaggtctgcagttcaagaccagcctggccaacgtggcaaagccccatctctactgaaaatacaagaaaattagccaggcgtgatgtgcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctag

SEQ ID NO: 15766 - DNA, 276 bp, synthetic construct
  misc_feature 1..276: note = Synthetic polypeptide
  source 1..276: mol_type = other DNA
cagtcagccttctgtatctgtgggttctgcatccaagggttcaacccacggcagagtcacccaactgtgaactgaaaatattcaggaaaaaaatggatgattgcatctgtactgaacagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtga

SEQ ID NO: 15767 - DNA, 346 bp, synthetic construct; identical to SEQ ID NO: 13741
  misc_feature 1..346: note = Synthetic polypeptide
  source 1..346: mol_type = other DNA

SEQ ID NO: 15768 - DNA, 323 bp, synthetic construct; identical to SEQ ID NO: 13742
  misc_feature 1..323: note = Synthetic polypeptide
  source 1..323: mol_type = other DNA

SEQ ID NO: 15769 - DNA, 279 bp, synthetic construct
  misc_feature 1..279: note = Synthetic polypeptide
  source 1..279: mol_type = other DNA
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggctggagtgcagtggcgcgatctcggctcactgcaacctccgcctcccaggttcaaccaattctcctgcctcagcctcccgagtag

SEQ ID NO: 15770 - DNA, 751 bp, synthetic construct
  misc_feature 1..751: note = Synthetic polypeptide
  source 1..751: mol_type = other DNA
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaa

SEQ ID NO: 15771 - DNA, 338 bp, synthetic construct
  misc_feature 1..338: note = Synthetic polypeptide
  source 1..338: mol_type = other DNA
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagatttta

SEQ ID NO: 15772 - DNA, 110 bp, synthetic construct
  misc_feature 1..110: note = Synthetic polypeptide
  source 1..110: mol_type = other DNA
ggctggttttaagacaattatctcctatattgatgagcaatttgagaggtacctgcatgacgagagcggcttgaacaggcggcacatcattgataatagggtgcattgtt

SEQ ID NO: 15773 - DNA, 73 bp, synthetic construct
  misc_feature 1..73: note = Synthetic polypeptide
  source 1..73: mol_type = other DNA
ggctggttttaagacaattatctcctatattgatgagcaatttgagaggtacctgcatgacgagagcggcttg

SEQ ID NO: 15774 - DNA, 148 bp, synthetic construct
  misc_feature 1..148: note = Synthetic polypeptide
  source 1..148: mol_type = other DNA
ggctggttttaagacaattatctcctatattgatgagcaatttgagaggtacctgcatgacgagagcggcttgaacaggcggcacatcattgataatagggtgcattgttgcttttactttatttcaccttttggacatggacttaag

SEQ ID NO: 15775 - DNA, 58 bp, synthetic construct
  misc_feature 1..58: note = Synthetic polypeptide
  source 1..58: mol_type = other DNA
ggctggttttaagacaattatctcctatattgatgagcaatttgagaggtacctgcat

SEQ ID NO: 15776 - DNA, 185 bp, synthetic construct
  misc_feature 1..185: note = Synthetic polypeptide
  source 1..185: mol_type = other DNA
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 15777 - DNA, 234 bp, synthetic construct
  misc_feature 1..234: note = Synthetic polypeptide
  source 1..234: mol_type = other DNA
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaa

SEQ ID NO: 15778 - DNA, 237 bp, synthetic construct; identical to SEQ ID NO: 10809
  misc_feature 1..237: note = Synthetic polypeptide
  source 1..237: mol_type = other DNA

SEQ ID NO: 15779 - DNA, 4080 bp, synthetic construct; identical to SEQ ID NO: 10810
  misc_feature 1..4080: note = Synthetic polypeptide
  source 1..4080: mol_type = other DNA

SEQ ID NO: 15780 - DNA, 4119 bp, synthetic construct; identical to SEQ ID NO: 10811
  misc_feature 1..4119: note = Synthetic polypeptide
  source 1..4119: mol_type = other DNA

SEQ ID NO: 15781 - DNA, 595 bp, synthetic construct; identical to SEQ ID NO: 10812
  misc_feature 1..595: note = Synthetic polypeptide
  source 1..595: mol_type = other DNA

SEQ ID NO: 15782 - DNA, 921 bp, synthetic construct; identical to SEQ ID NO: 8811
  misc_feature 1..921: note = Synthetic polypeptide
  source 1..921: mol_type = other DNA

SEQ ID NO: 15783 - DNA, 241 bp, synthetic construct
  misc_feature 1..241: note = Synthetic polypeptide
  source 1..241: mol_type = other DNA
ggcgggggcggggccgagcacgcgcgtgcgcagaaaggccggcgcggcaggctgaggagaaagcggcgcgcggagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 15784 - DNA, 464 bp, synthetic construct
  misc_feature 1..464: note = Synthetic polypeptide
  source 1..464: mol_type = other DNA
ggcgggggcggggccgagcacgcgcgtgcgcagaaaggccggcgcggcaggctgaggagaaagcggcgcgcggagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 15785 - DNA, 990 bp, synthetic construct
  misc_feature 1..990: note = Synthetic polypeptide
  source 1..990: mol_type = other DNA
ggcgagcggcgacggcggcggcggcgggcacagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15786 - DNA, 852 bp, synthetic construct
  misc_feature 1..852: note = Synthetic polypeptide
  source 1..852: mol_type = other DNA
ggcgagcggcgacggcggcggcggcgggcacagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15787 - DNA, 150 bp, synthetic construct
  misc_feature 1..150: note = Synthetic polypeptide
  source 1..150: mol_type = other DNA
ggcgagcggcgacggcggcggcggcgggcacagacagatgcaccatcaggaatggaattacagtcatggtatcctgttataaagcaggaaggtgaccatgtttctcagacacattcatttttacaccccagatgcatcaatctcaaataa

SEQ ID NO: 15788 - DNA, 3701 bp, synthetic construct; identical to SEQ ID NO: 6659
  misc_feature 1..3701: note = Synthetic polypeptide
  source 1..3701: mol_type = other DNA

SEQ ID NO: 15789 - DNA, 3527 bp, synthetic construct; identical to SEQ ID NO: 6660
  misc_feature 1..3527: note = Synthetic polypeptide
  source 1..3527: mol_type = other DNA

SEQ ID NO: 15790 - DNA, 457 bp, synthetic construct; identical to SEQ ID NO: 6661
  misc_feature 1..457: note = Synthetic polypeptide
  source 1..457: mol_type = other DNA

SEQ ID NO: 15791 - DNA, 359 bp, synthetic construct; identical to SEQ ID NO: 6662
  misc_feature 1..359: note = Synthetic polypeptide
  source 1..359: mol_type = other DNA

SEQ ID NO: 15792 - DNA, 588 bp, synthetic construct; identical to SEQ ID NO: 6663
  misc_feature 1..588: note = Synthetic polypeptide
  source 1..588: mol_type = other DNA

SEQ ID NO: 15793 - DNA, 1986 bp, synthetic construct
  misc_feature 1..1986: note = Synthetic polypeptide
  source 1..1986: mol_type = other DNA
agccaggcatggtgatgcgtgcctgtagccccagctacgtgggaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctga

SEQ ID NO: 15794 - DNA, 367 bp, synthetic construct; identical to SEQ ID NO: 13636
  misc_feature 1..367: note = Synthetic polypeptide
  source 1..367: mol_type = other DNA

SEQ ID NO: 15795 - DNA, 358 bp, synthetic construct; identical to SEQ ID NO: 13637
  misc_feature 1..358: note = Synthetic polypeptide
  source 1..358: mol_type = other DNA

SEQ ID NO: 15796 - DNA, 1966 bp, synthetic construct
  misc_feature 1..1966: note = Synthetic polypeptide
  source 1..1966: mol_type = other DNA
ggcggcgctgccgctcccgggcggccgcgggcggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaa

SEQ ID NO: 15797 - DNA, 96 bp, synthetic construct
  misc_feature 1..96: note = Synthetic polypeptide
  source 1..96: mol_type = other DNA
ggcggcgctgccgctcccgggcggccgcgggcggaccagaatggaaacgaccttcggacccgccttttcagccgtcaccaccatcacaaaagctga

SEQ ID NO: 15798 - DNA, 394 bp, synthetic construct
  misc_feature 1..394: note = Synthetic polypeptide
  source 1..394: mol_type = other DNA
ggcggcgctgccgctcccgggcggccgcgggcggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtggg

SEQ ID NO: 15799 - DNA, 1518 bp, synthetic construct
  misc_feature 1..1518: note = Synthetic polypeptide
  source 1..1518: mol_type = other DNA
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15800 - DNA, 1437 bp, synthetic construct
  misc_feature 1..1437: note = Synthetic polypeptide
  source 1..1437: mol_type = other DNA
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15801 - DNA, 1395 bp, synthetic construct
  misc_feature 1..1395: note = Synthetic polypeptide
  source 1..1395: mol_type = other DNA
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15802 - DNA, 354 bp, synthetic construct
  misc_feature 1..354: note = Synthetic polypeptide
  source 1..354: mol_type = other DNA
gccagacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaa

SEQ ID NO: 15803 - DNA, 2281 bp, synthetic construct
  misc_feature 1..2281: note = Synthetic polypeptide
  source 1..2281: mol_type = other DNA
tggctgtcaagatggctgaataggaatagctccagtctgtagctcccagtgagatcaatgcaggaagtgggtgatttctgcatttccaactgagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactag

SEQ ID NO: 15804 - DNA, 809 bp, synthetic construct; identical to SEQ ID NO: 8643
  misc_feature 1..809: note = Synthetic polypeptide
  source 1..809: mol_type = other DNA

SEQ ID NO: 15805 - DNA, 1114 bp, synthetic construct; identical to SEQ ID NO: 7732
  misc_feature 1..1114: note = Synthetic polypeptide
  source 1..1114: mol_type = other DNA

SEQ ID NO: 15806 - DNA, 363 bp, synthetic construct; identical to SEQ ID NO: 7733
  misc_feature 1..363: note = Synthetic polypeptide
  source 1..363: mol_type = other DNA

SEQ ID NO: 15807 - DNA, 113 bp, synthetic construct; identical to SEQ ID NO: 9062
  misc_feature 1..113: note = Synthetic polypeptide
  source 1..113: mol_type = other DNA

SEQ ID NO: 15808 - DNA, 1099 bp, synthetic construct
  misc_feature 1..1099: note = Synthetic polypeptide
  source 1..1099: mol_type = other DNA
tgggcaaaggacttgtggagttcaaagacgtacaagtgatcaacaaacacatggaaagttctcaacatcattagtcattaaagaaatgcacataaaaaaccacaatgaggtatcatttcctacccactaggatggctatttaaaaacacaaaaggaaagtaacaagtatgattgaggacgtggagaaattggagcccttatacgttgctcatgtgaatgtaaaatggtacagccaccatggcaattccttaaaaagttaaactaaggtttcccatgtgactcagcagttccacctgttgtgtatgcccaaaagaattgaaaacagatactcaaatacatgtatatgcatattcatagcagctctattcataaaagccaaaaggtggaatttaacagctctattcataaaagccaaaaggtggaaacaatttagatttccatcaggagatgattggatagacaaattatggtgtacgcatacagtggagtattattcagtcataaaaacggtatactaatatgtgctgcataatacggacggaccttaaacatactaagtgaaagaagccagacacaaaagctaacatgttgtttgcttctatttcatgaagtatccaaaataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctga

SEQ ID NO: 15809 - DNA, 421 bp, synthetic construct
  misc_feature 1..421: note = Synthetic polypeptide
  source 1..421: mol_type = other DNA
gccgggcgcagttgctcacgcctgtaatcccagcactttgggaggccgaggtgggcggatcatctgagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggggctggctgtgggcaatggactctcctcctatga

SEQ ID NO: 15810 - DNA, 1222 bp, synthetic construct
  misc_feature 1..1222: note = Synthetic polypeptide
  source 1..1222: mol_type = other DNA
gccgggcgcagttgctcacgcctgtaatcccagcactttgggaggccgaggtgggcggatcatctgagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactga

SEQ ID NO: 15811 - DNA, 1171 bp, synthetic construct
  misc_feature 1..1171: note = Synthetic polypeptide
  source 1..1171: mol_type = other DNA
gccgggcgcagttgctcacgcctgtaatcccagcactttgggaggccgaggtgggcggatcatctgagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactga

SEQ ID NO: 15812 - DNA, 108 bp, synthetic construct
  misc_feature 1..108: note = Synthetic polypeptide
  source 1..108: mol_type = other DNA
gccgggcgcagttgctcacgcctgtaatcccagcactttgggaggccgaggtgggcggatcatctgagagcatggccccttcctggtccagccagatggtgtcaccct

SEQ ID NO: 15813 - DNA, 993 bp, synthetic construct
  misc_feature 1..993: note = Synthetic polypeptide
  source 1..993: mol_type = other DNA
tttctgaacgtcagttgttttctcatctgtaaaatgacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15814 - DNA, 855 bp, synthetic construct
  misc_feature 1..855: note = Synthetic polypeptide
  source 1..855: mol_type = other DNA
tttctgaacgtcagttgttttctcatctgtaaaatgacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15815 - DNA, 153 bp, synthetic construct
  misc_feature 1..153: note = Synthetic polypeptide
  source 1..153: mol_type = other DNA
tttctgaacgtcagttgttttctcatctgtaaaatgacagatgcaccatcaggaatggaattacagtcatggtatcctgttataaagcaggaaggtgaccatgtttctcagacacattcatttttacaccccagatgcatcaatctcaaataa

SEQ ID NO: 15816 - DNA, 829 bp, synthetic construct; identical to SEQ ID NO: 8675
  misc_feature 1..829: note = Synthetic polypeptide
  source 1..829: mol_type = other DNA

SEQ ID NO: 15817 - DNA, 2624 bp, synthetic construct; identical to SEQ ID NO: 8408
  misc_feature 1..2624: note = Synthetic polypeptide
  source 1..2624: mol_type = other DNA

SEQ ID NO: 15818 - DNA, 2678 bp, synthetic construct; identical to SEQ ID NO: 8409
  misc_feature 1..2678: note = Synthetic polypeptide
  source 1..2678: mol_type = other DNA

SEQ ID NO: 15819 - DNA, 2717 bp, synthetic construct; identical to SEQ ID NO: 8410
  misc_feature 1..2717: note = Synthetic polypeptide
  source 1..2717: mol_type = other DNA

SEQ ID NO: 15820 - DNA, 2624 bp, synthetic construct; identical to SEQ ID NO: 8411
  misc_feature 1..2624: note = Synthetic polypeptide
  source 1..2624: mol_type = other DNA

SEQ ID NO: 15821 - DNA, 2783 bp, synthetic construct; identical to SEQ ID NO: 8412
  misc_feature 1..2783: note = Synthetic polypeptide
  source 1..2783: mol_type = other DNA

SEQ ID NO: 15822 - DNA, 2696 bp, synthetic construct; identical to SEQ ID NO: 8413
  misc_feature 1..2696: note = Synthetic polypeptide
  source 1..2696: mol_type = other DNA

SEQ ID NO: 15823 - DNA, 2678 bp, synthetic construct; identical to SEQ ID NO: 8414
  misc_feature 1..2678: note = Synthetic polypeptide
  source 1..2678: mol_type = other DNA

SEQ ID NO: 15824 - DNA, 677 bp, synthetic construct; identical to SEQ ID NO: 8415
  misc_feature 1..677: note = Synthetic polypeptide
  source 1..677: mol_type = other DNA

SEQ ID NO: 15825 - DNA, 183 bp, synthetic construct; identical to SEQ ID NO: 13314
  misc_feature 1..183: note = Synthetic polypeptide
  source 1..183: mol_type = other DNA

SEQ ID NO: 15826 - DNA, 104 bp, synthetic construct; identical to SEQ ID NO: 13315
  misc_feature 1..104: note = Synthetic polypeptide
  source 1..104: mol_type = other DNA

SEQ ID NO: 15827 - DNA, 1085 bp, synthetic construct
  misc_feature 1..1085: note = Synthetic polypeptide
  source 1..1085: mol_type = other DNA
gggcgcggggcgcgccgccatgggcctggccgggctgcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 15828 - DNA, 2556 bp, synthetic construct
  misc_feature 1..2556: note = Synthetic polypeptide
  source 1..2556: mol_type = other DNA
ggtacacactgcagtgtgggtgaacgtcaaaagccgtgcagtgagagaagccaatcacagtaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtag

SEQ ID NO: 15829 - DNA, 2917 bp, synthetic construct
  misc_feature 1..2917: note = Synthetic polypeptide
  source 1..2917: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15830 - DNA, 3148 bp, synthetic construct
  misc_feature 1..3148: note = Synthetic polypeptide
  source 1..3148: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15831 - DNA, 1278 bp, synthetic construct
  misc_feature 1..1278: note = Synthetic polypeptide
  source 1..1278: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15832 - DNA, 3130 bp, synthetic construct
  misc_feature 1..3130: note = Synthetic polypeptide
  source 1..3130: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15833 - DNA, 2293 bp, synthetic construct
  misc_feature 1..2293: note = Synthetic polypeptide
  source 1..2293: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15834 - DNA, 1462 bp, synthetic construct
  misc_feature 1..1462: note = Synthetic polypeptide
  source 1..1462: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15835 - DNA, 2917 bp, synthetic construct
  misc_feature 1..2917: note = Synthetic polypeptide
  source 1..2917: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15836 - DNA, 1531 bp, synthetic construct
  misc_feature 1..1531: note = Synthetic polypeptide
  source 1..1531: mol_type = other DNA
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgaga

SEQ ID NO: 15837 - DNA, 1346 bp, synthetic construct; identical to SEQ ID NO: 7758
  misc_feature 1..1346: note = Synthetic polypeptide
  source 1..1346: mol_type = other DNA

SEQ ID NO: 15838 - DNA, 331 bp, synthetic construct; identical to SEQ ID NO: 7504
  misc_feature 1..331: note = Synthetic polypeptide
  source 1..331: mol_type = other DNA

SEQ ID NO: 15839 - DNA, 1454 bp, synthetic construct
  misc_feature 1..1454: note = Synthetic polypeptide
  source 1..1454: mol_type = other DNA
tttcttggttccctgactgggaagcaaggtgattaatggacggtcaaggcagccccttaggcggcttaggcctgccctgtgggggactctggccagcttgagcgacgcagatcctgagagcgctcccgggtaggcaactgccccggtggaatgccttgccagagcagtgcgtggcaggcccccgtggaggatcaatgtggtggctgatcaccaggaaggaattggcacttggagtccggacatctgaaacttggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtga

SEQ ID NO: 15840 - DNA, 587 bp, synthetic construct; identical to SEQ ID NO: 10160
  misc_feature 1..587: note = Synthetic polypeptide
  source 1..587: mol_type = other DNA

SEQ ID NO: 15841 - DNA, 1246 bp, synthetic construct; identical to SEQ ID NO: 10161
  misc_feature 1..1246: note = Synthetic polypeptide
  source 1..1246: mol_type = other DNA

SEQ ID NO: 15842 - DNA, 1768 bp, synthetic construct; identical to SEQ ID NO: 10162
  misc_feature 1..1768: note = Synthetic polypeptide
  source 1..1768: mol_type = other DNA

SEQ ID NO: 15843 - DNA, 1054 bp, synthetic construct; identical to SEQ ID NO: 10163
  misc_feature 1..1054: note = Synthetic polypeptide
  source 1..1054: mol_type = other DNA

SEQ ID NO: 15844 - DNA, 553 bp, synthetic construct; identical to SEQ ID NO: 10164
  misc_feature 1..553: note = Synthetic polypeptide
  source 1..553: mol_type = other DNA

SEQ ID NO: 15845 - DNA, 433 bp, synthetic construct; identical to SEQ ID NO: 14273
  misc_feature 1..433: note = Synthetic polypeptide
  source 1..433: mol_type = other DNA

SEQ ID NO: 15846 - DNA, 168 bp, synthetic construct; identical to SEQ ID NO: 13695
  misc_feature 1..168: note = Synthetic polypeptide
  source 1..168: mol_type = other DNA

SEQ ID NO: 15847 - DNA, 3717 bp, synthetic construct; identical to SEQ ID NO: 7131
  misc_feature 1..3717: note = Synthetic polypeptide
  source 1..3717: mol_type = other DNA

SEQ ID NO: 15848 - DNA, 3636 bp, synthetic construct; identical to SEQ ID NO: 7132
  misc_feature 1..3636: note = Synthetic polypeptide
  source 1..3636: mol_type = other DNA

SEQ ID NO: 15849 - DNA, 20 bp, synthetic construct
  misc_feature 1..20: note = Synthetic polypeptide
  source 1..20: mol_type = other DNA
tgagaggattcctgagctga

SEQ ID NO: 15850 - DNA, 2822 bp, synthetic construct; identical to SEQ ID NO: 9433
  misc_feature 1..2822: note = Synthetic polypeptide
  source 1..2822: mol_type = other DNA

SEQ ID NO: 15851 - DNA, 787 bp, synthetic construct
  misc_feature 1..787: note = Synthetic polypeptide
  source 1..787: mol_type = other DNA
tgtcagtctaccccaggaggcagggatatccctaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccgtcaggaagaagaaagggaacagccccatctcctga

SEQ ID NO: 15852 - DNA, 814 bp, synthetic construct
  misc_feature 1..814: note = Synthetic polypeptide
  source 1..814: mol_type = other DNA
tgtcagtctaccccaggaggcagggatatccctaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataa

SEQ ID NO: 15853 - DNA, 430 bp, synthetic construct
  misc_feature 1..430: note = Synthetic polypeptide
  source 1..430: mol_type = other DNA
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaa

SEQ ID NO: 15854 - DNA, 478 bp, synthetic construct
  misc_feature 1..478: note = Synthetic polypeptide
  source 1..478: mol_type = other DNA
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttag

SEQ ID NO: 15855 - DNA, 400 bp, synthetic construct
  misc_feature 1..400: note = Synthetic polypeptide
  source 1..400: mol_type = other DNA
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttcttt

SEQ ID NO: 15856 - DNA, 1002 bp, synthetic construct
  misc_feature 1..1002: note = Synthetic polypeptide
  source 1..1002: mol_type = other DNA
ggctgggcatggtggctcacgcctataatcctggcactttgggagactgaggcaagcgaattgcctgagctcaggagttcaagaccagctttggcaatacgacaaaaccccgtctctactacagatacaaaaaaaattaaccagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 15857 - DNA, 2120 bp, synthetic construct; identical to SEQ ID NO: 6752
  misc_feature 1..2120: note = Synthetic polypeptide
  source 1..2120: mol_type = other DNA

SEQ ID NO: 15858 - DNA, 1445 bp, synthetic construct
  misc_feature 1..1445: note = Synthetic polypeptide
  source 1..1445: mol_type = other DNA
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattga

SEQ ID NO: 15859 - DNA, 1472 bp, synthetic construct
  misc_feature 1..1472: note = Synthetic polypeptide
  source 1..1472: mol_type = other DNA
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattga

SEQ ID NO: 15860 - DNA, 797 bp, synthetic construct
  misc_feature 1..797: note = Synthetic polypeptide
  source 1..797: mol_type = other DNA
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctga

SEQ ID NO: 15861 - DNA, 732 bp, synthetic construct
  misc_feature 1..732: note = Synthetic polypeptide
  source 1..732: mol_type = other DNA
caggaatctcaaagagctatccacacttccatgttcatcatagcattatttaccatagccaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctga

SEQ ID NO: 15862 - DNA, 4417 bp, synthetic construct; identical to SEQ ID NO: 8392
  misc_feature 1..4417: note = Synthetic polypeptide
  source 1..4417: mol_type = other DNA

SEQ ID NO: 15863 - DNA, 810 bp, synthetic construct
  misc_feature 1..810: note = Synthetic polypeptide
  source 1..810: mol_type = other DNA
ccctgctacttcaagagggtgttggaccagcagcattcgtatcatctgggagatggctgcaaagacagtatctaagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15864 - DNA, 3963 bp, synthetic construct
  misc_feature 1..3963: note = Synthetic polypeptide
  source 1..3963: mol_type = other DNA
caggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaa

SEQ ID NO: 15865 - DNA, 707 bp, synthetic construct
  misc_feature 1..707: note = Synthetic polypeptide
  source 1..707: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaa

SEQ ID NO: 15866 - DNA, 575 bp, synthetic construct
  misc_feature 1..575: note = Synthetic polypeptide
  source 1..575: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaa

SEQ ID NO: 15867 - DNA, 542 bp, synthetic construct
  misc_feature 1..542: note = Synthetic polypeptide
  source 1..542: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 15868 - DNA, 533 bp, synthetic construct
  misc_feature 1..533: note = Synthetic polypeptide
  source 1..533: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcc

SEQ ID NO: 15869 - DNA, 434 bp, synthetic construct
  misc_feature 1..434: note = Synthetic polypeptide
  source 1..434: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaaccca

SEQ ID NO: 15870 - DNA, 337 bp, synthetic construct
  misc_feature 1..337: note = Synthetic polypeptide
  source 1..337: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggg

SEQ ID NO: 15871 - DNA, 188 bp, synthetic construct
  misc_feature 1..188: note = Synthetic polypeptide
  source 1..188: mol_type = other DNA
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacag

SEQ ID NO: 15872 - DNA, 1327 bp, synthetic construct; identical to SEQ ID NO: 6801
  misc_feature 1..1327: note = Synthetic polypeptide
  source 1..1327: mol_type = other DNA

SEQ ID NO: 15873 - DNA, 650 bp, synthetic construct; identical to SEQ ID NO: 13186
  misc_feature 1..650: note = Synthetic polypeptide
  source 1..650: mol_type = other DNA

SEQ ID NO: 15874 - DNA, 521 bp, synthetic construct; identical to SEQ ID NO: 13187
  misc_feature 1..521: note = Synthetic polypeptide
  source 1..521: mol_type = other DNA

SEQ ID NO: 15875 - DNA, 524 bp, synthetic construct; identical to SEQ ID NO: 13188
  misc_feature 1..524: note = Synthetic polypeptide
  source 1..524: mol_type = other DNA

SEQ ID NO: 15876 - DNA, 996 bp, synthetic construct; identical to SEQ ID NO: 13189
  misc_feature 1..996: note = Synthetic polypeptide
  source 1..996: mol_type = other DNA

SEQ ID NO: 15877 - DNA, 717 bp, synthetic construct; identical to SEQ ID NO: 13190
  misc_feature 1..717: note = Synthetic polypeptide
  source 1..717: mol_type = other DNA

SEQ ID NO: 15878 - DNA, 404 bp, synthetic construct; identical to SEQ ID NO: 13191
  misc_feature 1..404: note = Synthetic polypeptide
  source 1..404: mol_type = other DNA

SEQ ID NO: 15879 - DNA, 404 bp, synthetic construct; identical to SEQ ID NO: 13192
  misc_feature 1..404: note = Synthetic polypeptide
  source 1..404: mol_type = other DNA

SEQ ID NO: 15880 - DNA, 395 bp, synthetic construct; identical to SEQ ID NO: 13193
  misc_feature 1..395: note = Synthetic polypeptide
  source 1..395: mol_type = other DNA

SEQ ID NO: 15881 - DNA, 280 bp, synthetic construct
  misc_feature 1..280: note = Synthetic polypeptide
  source 1..280: mol_type = other DNA
tctaagctcttgtgtgtttggtttttggccatcgctttcactgctctttaagctcccccagaggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctga

SEQ ID NO: 15882 - DNA, 749 bp, synthetic construct
  misc_feature 1..749: note = Synthetic polypeptide
  source 1..749: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaa

SEQ ID NO: 15883 - DNA, 617 bp, synthetic construct
  misc_feature 1..617: note = Synthetic polypeptide
  source 1..617: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaa

SEQ ID NO: 15884 - DNA, 584 bp, synthetic construct
  misc_feature 1..584: note = Synthetic polypeptide
  source 1..584: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 15885 - DNA, 575 bp, synthetic construct
  misc_feature 1..575: note = Synthetic polypeptide
  source 1..575: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcc

SEQ ID NO: 15886 - DNA, 476 bp, synthetic construct
  misc_feature 1..476: note = Synthetic polypeptide
  source 1..476: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaaccca

SEQ ID NO: 15887 - DNA, 379 bp, synthetic construct
  misc_feature 1..379: note = Synthetic polypeptide
  source 1..379: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggg

SEQ ID NO: 15888 - DNA, 230 bp, synthetic construct
  misc_feature 1..230: note = Synthetic polypeptide
  source 1..230: mol_type = other DNA
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacag

SEQ ID NO: 15889 - DNA, 309 bp, synthetic construct; identical to SEQ ID NO: 8320
  misc_feature 1..309: note = Synthetic polypeptide
  source 1..309: mol_type = other DNA

SEQ ID NO: 15890 - DNA, 282 bp, synthetic construct
  misc_feature 1..282: note = Synthetic polypeptide
  source 1..282: mol_type = other DNA
aggcccatcagctgactttaaagataggaaggttatcctggattgtcttgtctagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 15891 - DNA, 1232 bp, synthetic construct; identical to SEQ ID NO: 6566
  misc_feature 1..1232: note = Synthetic polypeptide
  source 1..1232: mol_type = other DNA

SEQ ID NO: 15892 - DNA, 497 bp, synthetic construct; identical to SEQ ID NO: 6567
  misc_feature 1..497: note = Synthetic polypeptide
  source 1..497: mol_type = other DNA

SEQ ID NO: 15893 - DNA, 575 bp, synthetic construct; identical to SEQ ID NO: 6568
  misc_feature 1..575: note = Synthetic polypeptide
  source 1..575: mol_type = other DNA

SEQ ID NO: 15894 - DNA, 646 bp, synthetic construct; identical to SEQ ID NO: 7772
  misc_feature 1..646: note = Synthetic polypeptide
  source 1..646: mol_type = other DNA

SEQ ID NO: 15895 - DNA, 304 bp, synthetic construct; identical to SEQ ID NO: 7773
  misc_feature 1..304: note = Synthetic polypeptide
  source 1..304: mol_type = other DNA

SEQ ID NO: 15896 - DNA, 619 bp, synthetic construct; identical to SEQ ID NO: 7774
  misc_feature 1..619: note = Synthetic polypeptide
  source 1..619: mol_type = other DNA

SEQ ID NO: 15897 - DNA, 523 bp, synthetic construct; identical to SEQ ID NO: 7775
  misc_feature 1..523: note = Synthetic polypeptide
  source 1..523: mol_type = other DNA

SEQ ID NO: 15898 - DNA, 441 bp, synthetic construct; identical to SEQ ID NO: 7776
  misc_feature 1..441: note = Synthetic polypeptide
  source 1..441: mol_type = other DNA

SEQ ID NO: 15899 - DNA, 167 bp, synthetic construct; identical to SEQ ID NO: 7777
  misc_feature 1..167: note = Synthetic polypeptide
  source 1..167: mol_type = other DNA

SEQ ID NO: 15900 - DNA, 1217 bp, synthetic construct
  misc_feature 1..1217: note = Synthetic polypeptide
  source 1..1217: mol_type = other DNA
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15901 - DNA, 1178 bp, synthetic construct
  misc_feature 1..1178: note = Synthetic polypeptide
  source 1..1178: mol_type = other DNA
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15902 - DNA, 1133 bp, synthetic construct
  misc_feature 1..1133: note = Synthetic polypeptide
  source 1..1133: mol_type = other DNA
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15903 - DNA, 2419 bp, synthetic construct; identical to SEQ ID NO: 7455
  misc_feature 1..2419: note = Synthetic polypeptide
  source 1..2419: mol_type = other DNA

SEQ ID NO: 15904 - DNA, 1756 bp, synthetic construct; identical to SEQ ID NO: 11056
  misc_feature 1..1756: note = Synthetic polypeptide
  source 1..1756: mol_type = other DNA

SEQ ID NO: 15905 - DNA, 2825 bp, synthetic construct; identical to SEQ ID NO: 6727
  misc_feature 1..2825: note = Synthetic polypeptide
  source 1..2825: mol_type = other DNA

SEQ ID NO: 15906 - DNA, 337 bp, synthetic construct; identical to SEQ ID NO: 6393
  misc_feature 1..337: note = Synthetic polypeptide
  source 1..337: mol_type = other DNA

SEQ ID NO: 15907 - DNA, 1022 bp, synthetic construct; identical to SEQ ID NO: 590
  misc_feature 1..1022: note = Synthetic polypeptide
  source 1..1022: mol_type = other DNA

SEQ ID NO: 15908 - DNA, 347 bp, synthetic construct; identical to SEQ ID NO: 591
  misc_feature 1..347: note = Synthetic polypeptide
  source 1..347: mol_type = other DNA

SEQ ID NO: 15909 - DNA, 1109 bp, synthetic construct; identical to SEQ ID NO: 592
  misc_feature 1..1109: note = Synthetic polypeptide
  source 1..1109: mol_type = other DNA

SEQ ID NO: 15910 - DNA, 85 bp, synthetic construct; identical to SEQ ID NO: 601
  misc_feature 1..85: note = Synthetic polypeptide
  source 1..85: mol_type = other DNA

SEQ ID NO: 15911 - DNA, 269 bp, synthetic construct; identical to SEQ ID NO: 600
  misc_feature 1..269: note = Synthetic polypeptide
  source 1..269: mol_type = other DNA

SEQ ID NO: 15912 - DNA, 459 bp, synthetic construct; identical to SEQ ID NO: 8555
  misc_feature 1..459: note = Synthetic polypeptide
  source 1..459: mol_type = other DNA

SEQ ID NO: 15913 - DNA, 871 bp, synthetic construct; identical to SEQ ID NO: 437
  misc_feature 1..871: note = Synthetic polypeptide
  source 1..871: mol_type = other DNA

SEQ ID NO: 15914 - DNA, 421 bp, synthetic construct; identical to SEQ ID NO: 441
  misc_feature 1..421: note = Synthetic polypeptide
  source 1..421: mol_type = other DNA

SEQ ID NO: 15915 - DNA, 638 bp, synthetic construct; identical to SEQ ID NO: 442
  misc_feature 1..638: note = Synthetic polypeptide
  source 1..638: mol_type = other DNA

SEQ ID NO: 15916 - DNA, 337 bp, synthetic construct; identical to SEQ ID NO: 443
  misc_feature 1..337: note = Synthetic polypeptide
  source 1..337: mol_type = other DNA

SEQ ID NO: 15917 - DNA, 1033 bp, synthetic construct; identical to SEQ ID NO: 7576
  misc_feature 1..1033: note = Synthetic polypeptide
  source 1..1033: mol_type = other DNA

SEQ ID NO: 15918 - DNA, 1048 bp, synthetic construct; identical to SEQ ID NO: 7577
  misc_feature 1..1048: note = Synthetic polypeptide
  source 1..1048: mol_type = other DNA

SEQ ID NO: 15919 - DNA, 966 bp, synthetic construct
  misc_feature 1..966: note = Synthetic polypeptide
  source 1..966: mol_type = other DNA
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtga

SEQ ID NO: 15920 - DNA, 738 bp, synthetic construct
  misc_feature 1..738: note = Synthetic polypeptide
  source 1..738: mol_type = other DNA
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacc

SEQ ID NO: 15921 - DNA, 539 bp, synthetic construct
  misc_feature 1..539: note = Synthetic polypeptide
  source 1..539: mol_type = other DNA
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgc

SEQ ID NO: 15922 - DNA, 12210 bp, synthetic construct
  misc_feature 1..12210: note = Synthetic polypeptide
  source 1..12210: mol_type = other DNA
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 15923 - DNA, 1455 bp, synthetic construct
  misc_feature 1..1455: note = Synthetic polypeptide
  source 1..1455: mol_type = other DNA
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 15924 - DNA, 1275 bp, synthetic construct
  misc_feature 1..1275: note = Synthetic polypeptide
  source 1..1275: mol_type = other DNA
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaaggaataccagaaacacatggaaacttttgac

SEQ ID NO: 15925 - DNA, 3495 bp, synthetic construct
  misc_feature 1..3495: note = Synthetic polypeptide
  source 1..3495: mol_type = other DNA
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaa

SEQ ID NO: 15926 - DNA, 648 bp, synthetic construct; identical to SEQ ID NO: 12806
  misc_feature 1..648: note = Synthetic polypeptide
  source 1..648: mol_type = other DNA

SEQ ID NO: 15927 - DNA, 405 bp, synthetic construct; identical to SEQ ID NO: 12807
  misc_feature 1..405: note = Synthetic polypeptide
  source 1..405: mol_type = other DNA

SEQ ID NO: 15928 - DNA, 627 bp, synthetic construct; identical to SEQ ID NO: 12808
  misc_feature 1..627: note = Synthetic polypeptide
  source 1..627: mol_type = other DNA

SEQ ID NO: 15929 - DNA, 411 bp, synthetic construct; identical to SEQ ID NO: 12809
  misc_feature 1..411: note = Synthetic polypeptide
  source 1..411: mol_type = other DNA

SEQ ID NO: 15930 - DNA, 570 bp, synthetic construct; identical to SEQ ID NO: 12810
  misc_feature 1..570: note = Synthetic polypeptide
  source 1..570: mol_type = other DNA

SEQ ID NO: 15931 - DNA, 742 bp, synthetic construct; identical to SEQ ID NO: 6357
  misc_feature 1..742: note = Synthetic polypeptide
  source 1..742: mol_type = other DNA

SEQ ID NO: 15932 - DNA, 590 bp, synthetic construct; identical to SEQ ID NO: 6358
  misc_feature 1..590: note = Synthetic polypeptide
  source 1..590: mol_type = other DNA

SEQ ID NO: 15933 - DNA, 577 bp, synthetic construct; identical to SEQ ID NO: 6359
  misc_feature 1..577: note = Synthetic polypeptide
  source 1..577: mol_type = other DNA

SEQ ID NO: 15934 - DNA, 430 bp, synthetic construct; identical to SEQ ID NO: 6360
  misc_feature 1..430: note = Synthetic polypeptide
  source 1..430: mol_type = other DNA

SEQ ID NO: 15935 - DNA, 670 bp, synthetic construct; identical to SEQ ID NO: 6361
  misc_feature 1..670: note = Synthetic polypeptide
  source 1..670: mol_type = other DNA

SEQ ID NO: 15936 - DNA, 897 bp, synthetic construct
  misc_feature 1..897: note = Synthetic polypeptide
  source 1..897: mol_type = other DNA
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggagggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 15937 - DNA, 893 bp, synthetic construct; identical to SEQ ID NO: 12957
  misc_feature 1..893: note = Synthetic polypeptide
  source 1..893: mol_type = other DNA

SEQ ID NO: 15938 - DNA, 959 bp, synthetic construct; identical to SEQ ID NO: 12958
  misc_feature 1..959: note = Synthetic polypeptide
  source 1..959: mol_type = other DNA

SEQ ID NO: 15939 - DNA, 1028 bp, synthetic construct; identical to SEQ ID NO: 12959
  misc_feature 1..1028: note = Synthetic polypeptide
  source 1..1028: mol_type = other DNA

SEQ ID NO: 15940 - DNA, 887 bp, synthetic construct; identical to SEQ ID NO: 12960
  misc_feature 1..887: note = Synthetic polypeptide
  source 1..887: mol_type = other DNA

SEQ ID NO: 15941 - DNA, 163 bp, synthetic construct; identical to SEQ ID NO: 480
  misc_feature 1..163: note = Synthetic polypeptide
  source 1..163: mol_type = other DNA

SEQ ID NO: 15942 - DNA, 104 bp, synthetic construct; identical to SEQ ID NO: 481
  misc_feature 1..104: note = Synthetic polypeptide
  source 1..104: mol_type = other DNA

SEQ ID NO: 15943 - DNA, 1629 bp, synthetic construct; identical to SEQ ID NO: 8070
  misc_feature 1..1629: note = Synthetic polypeptide
  source 1..1629: mol_type = other DNA

SEQ ID NO: 15944 - DNA, 1500 bp, synthetic construct; identical to SEQ ID NO: 8071
  misc_feature 1..1500: note = Synthetic polypeptide
  source 1..1500: mol_type = other DNA

SEQ ID NO: 15945 - DNA, 829 bp, synthetic construct; identical to SEQ ID NO: 624
  misc_feature 1..829: note = Synthetic polypeptide
  source 1..829: mol_type = other DNA

SEQ ID NO: 15946 - DNA, 1331 bp, synthetic construct; identical to SEQ ID NO: 550
  misc_feature 1..1331: note = Synthetic polypeptide
  source 1..1331: mol_type = other DNA

SEQ ID NO: 15947 - DNA, 1028 bp, synthetic construct; identical to SEQ ID NO: 551
  misc_feature 1..1028: note = Synthetic polypeptide
  source 1..1028: mol_type = other DNA

SEQ ID NO: 15948 - DNA, 1295 bp, synthetic construct; identical to SEQ ID NO: 553
  misc_feature 1..1295: note = Synthetic polypeptide
  source 1..1295: mol_type = other DNA

SEQ ID NO: 15949 - DNA, 1322 bp, synthetic construct; identical to SEQ ID NO: 554
  misc_feature 1..1322: note = Synthetic polypeptide
  source 1..1322: mol_type = other DNA

SEQ ID NO: 15950 - DNA, 1013 bp, synthetic construct; identical to SEQ ID NO: 555
  misc_feature 1..1013: note = Synthetic polypeptide
  source 1..1013: mol_type = other DNA

SEQ ID NO: 15951 - DNA, 139 bp, synthetic construct; identical to SEQ ID NO: 8939
  misc_feature 1..139: note = Synthetic polypeptide
  source 1..139: mol_type = other DNA

SEQ ID NO: 15952 - DNA, 368 bp, synthetic construct; identical to SEQ ID NO: 8940
  misc_feature 1..368: note = Synthetic polypeptide
  source 1..368: mol_type = other DNA

SEQ ID NO: 15953 - DNA, 2192 bp, synthetic construct; identical to SEQ ID NO: 8941
  misc_feature 1..2192: note = Synthetic polypeptide
  source 1..2192: mol_type = other DNA

SEQ ID NO: 15954 - DNA, 1328 bp, synthetic construct; identical to SEQ ID NO: 8942
  misc_feature 1..1328: note = Synthetic polypeptide
  source 1..1328: mol_type = other DNA

SEQ ID NO: 15955 - DNA, 2117 bp, synthetic construct; identical to SEQ ID NO: 8943
  misc_feature 1..2117: note = Synthetic polypeptide
  source 1..2117: mol_type = other DNA

SEQ ID NO: 15956 - DNA, 1265 bp, synthetic construct; identical to SEQ ID NO: 8944
  misc_feature 1..1265: note = Synthetic polypeptide
  source 1..1265: mol_type = other DNA

SEQ ID NO: 15957 - DNA, 1331 bp, synthetic construct; identical to SEQ ID NO: 8945
  misc_feature 1..1331: note = Synthetic polypeptide
  source 1..1331: mol_type = other DNA

SEQ ID NO: 15958 - DNA, 1365 bp, synthetic construct; identical to SEQ ID NO: 8252
  misc_feature 1..1365: note = Synthetic polypeptide
  source 1..1365: mol_type = other DNA

SEQ ID NO: 15959 - DNA, 503 bp, synthetic construct; identical to SEQ ID NO: 493
  misc_feature 1..503: note = Synthetic polypeptide
  source 1..503: mol_type = other DNA

SEQ ID NO: 15960 - DNA, 476 bp, synthetic construct; identical to SEQ ID NO: 495
  misc_feature 1..476: note = Synthetic polypeptide
  source 1..476: mol_type = other DNA

SEQ ID NO: 15961 - DNA, 539 bp, synthetic construct; identical to SEQ ID NO: 496
  misc_feature 1..539: note = Synthetic polypeptide
  source 1..539: mol_type = other DNA

SEQ ID NO: 15962 - DNA, 792 bp, synthetic construct; identical to SEQ ID NO: 6418
  misc_feature 1..792: note = Synthetic polypeptide
  source 1..792: mol_type = other DNA

SEQ ID NO: 15963 - DNA, 369 bp, synthetic construct; identical to SEQ ID NO: 6419
  misc_feature 1..369: note = Synthetic polypeptide
  source 1..369: mol_type = other DNA

SEQ ID NO: 15964 - DNA, 249 bp, synthetic construct; identical to SEQ ID NO: 6420
  misc_feature 1..249: note = Synthetic polypeptide
  source 1..249: mol_type = other DNA

SEQ ID NO: 15965 - DNA, 369 bp, synthetic construct; identical to SEQ ID NO: 6421
  misc_feature 1..369: note = Synthetic polypeptide
  source 1..369: mol_type = other DNA

SEQ ID NO: 15966 - DNA, 843 bp, synthetic construct; identical to SEQ ID NO: 6422
  misc_feature 1..843: note = Synthetic polypeptide
  source 1..843: mol_type = other DNA

SEQ ID NO: 15967 - DNA, 1833 bp, synthetic construct; identical to SEQ ID NO: 8747
  misc_feature 1..1833: note = Synthetic polypeptide
  source 1..1833: mol_type = other DNA

SEQ ID NO: 15968 - DNA, 1755 bp, synthetic construct; identical to SEQ ID NO: 8748
  misc_feature 1..1755: note = Synthetic polypeptide
  source 1..1755: mol_type = other DNA

SEQ ID NO: 15969 - DNA, 2120 bp, synthetic construct; identical to SEQ ID NO: 6752
  misc_feature 1..2120: note = Synthetic polypeptide
  source 1..2120: mol_type = other DNA

SEQ ID NO: 15970 - DNA, 1148 bp, synthetic construct; identical to SEQ ID NO: 436
  misc_feature 1..1148: note = Synthetic polypeptide
  source 1..1148: mol_type = other DNA

SEQ ID NO: 15971 - DNA, 1360 bp, synthetic construct; identical to SEQ ID NO: 7956
  misc_feature 1..1360: note = Synthetic polypeptide
  source 1..1360: mol_type = other DNA

SEQ ID NO: 15972 - DNA, 1222 bp, synthetic construct; identical to SEQ ID NO: 7957
  misc_feature 1..1222: note = Synthetic polypeptide
  source 1..1222: mol_type = other DNA

SEQ ID NO: 15973 - DNA, 80 bp, synthetic construct; identical to SEQ ID NO: 6364
  misc_feature 1..80: note = Synthetic polypeptide
  source 1..80: mol_type = other DNA

SEQ ID NO: 15974 - DNA, 217 bp, synthetic construct; identical to SEQ ID NO: 6365
  misc_feature 1..217: note = Synthetic polypeptide
  source 1..217: mol_type = other DNA

SEQ ID NO: 15975 - DNA, 158 bp, synthetic construct; identical to SEQ ID NO: 7602
  misc_feature 1..158: note = Synthetic polypeptide
  source 1..158: mol_type = other DNA

SEQ ID NO: 15976 - DNA, 665 bp, synthetic construct; identical to SEQ ID NO: 6374
  misc_feature 1..665: note = Synthetic polypeptide
  source 1..665: mol_type = other DNA

SEQ ID NO: 15977 - DNA, 518 bp, synthetic construct; identical to SEQ ID NO: 6375
  misc_feature 1..518: note = Synthetic polypeptide
  source 1..518: mol_type = other DNA

SEQ ID NO: 15978 - DNA, 423 bp, synthetic construct; identical to SEQ ID NO: 6550
  misc_feature 1..423: note = Synthetic polypeptide
  source 1..423: mol_type = other DNA

SEQ ID NO: 15979 - DNA, 934 bp, synthetic construct
  misc_feature 1..934: note = Synthetic polypeptide
  source 1..934: mol_type = other DNA
gtagacagactctcccagtgattccagcctcctggcactgacatcccctacccttgagtgtggacaggacctgtttcttgattctagccaagggaatatggcaaagatgataaaatatcactcccatgattatgttactatatacttatatatatgtatctgtcttgctagcaggcccactgtagggactctttctctctggccctgaaggagcaaacagtcatgaagtaagtggttggaggagggagaagcccaccttttaaggaacttggggcagcttctaggagccgaacgtggcctccagcaagaaactgaatcactcagtcctgcagccaccagaaatgaattctgccagcagtctgagtgaggttggcagtaaattctcccccggtggagcctccagaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctga

SEQ ID NO: 15980 - DNA, 811 bp, synthetic construct; identical to SEQ ID NO: 7500
  misc_feature 1..811: note = Synthetic polypeptide
  source 1..811: mol_type = other DNA

SEQ ID NO: 15981 - DNA, 1452 bp, synthetic construct; identical to SEQ ID NO: 7300
  misc_feature 1..1452: note = Synthetic polypeptide
  source 1..1452: mol_type = other DNA

SEQ ID NO: 15982 - DNA, 1149 bp, synthetic construct; identical to SEQ ID NO: 7301
  misc_feature 1..1149: note = Synthetic polypeptide
  source 1..1149: mol_type = other DNA

SEQ ID NO: 15983 - DNA, 1416 bp, synthetic construct; identical to SEQ ID NO: 7302
  misc_feature 1..1416: note = Synthetic polypeptide
  source 1..1416: mol_type = other DNA

SEQ ID NO: 15984 - DNA, 1443 bp, synthetic construct; identical to SEQ ID NO: 7303
  misc_feature 1..1443: note = Synthetic polypeptide
  source 1..1443: mol_type = other DNA

SEQ ID NO: 15985 - DNA, 1134 bp, synthetic construct; identical to SEQ ID NO: 7304
  misc_feature 1..1134: note = Synthetic polypeptide
  source 1..1134: mol_type = other DNA

SEQ ID NO: 15986 - DNA, 3380 bp, synthetic construct; identical to SEQ ID NO: 12414
  misc_feature 1..3380: note = Synthetic polypeptide
  source 1..3380: mol_type = other DNA

SEQ ID NO: 15987 - DNA, 3584 bp, synthetic construct; identical to SEQ ID NO: 12415
  misc_feature 1..3584: note = Synthetic polypeptide
  source 1..3584: mol_type = other DNA

SEQ ID NO: 15988 - DNA, 2672 bp, synthetic construct; identical to SEQ ID NO: 6621
  misc_feature 1..2672: note = Synthetic polypeptide
  source 1..2672: mol_type = other DNA

SEQ ID NO: 15989 - DNA, 1767 bp, synthetic construct; identical to SEQ ID NO: 6622
  misc_feature 1..1767: note = Synthetic polypeptide
  source 1..1767: mol_type = other DNA

SEQ ID NO: 15990 - DNA, 1692 bp, synthetic construct; identical to SEQ ID NO: 6623
  misc_feature 1..1692: note = Synthetic polypeptide
  source 1..1692: mol_type = other DNA

SEQ ID NO: 15991 - DNA, 1201 bp, synthetic construct
  misc_feature 1..1201: note = Synthetic polypeptide
  source 1..1201: mol_type = other DNA
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaa

SEQ ID NO: 15992 - DNA, 919 bp, synthetic construct
  misc_feature 1..919: note = Synthetic polypeptide
  source 1..919: mol_type = other DNA
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattaggatcgtga

SEQ ID NO: 15993 - DNA, 776 bp, synthetic construct
  misc_feature 1..776: note = Synthetic polypeptide
  source 1..776: mol_type = other DNA
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccc

SEQ ID NO: 15994 - DNA, 601 bp, synthetic construct
  misc_feature 1..601: note = Synthetic polypeptide
  source 1..601: mol_type = other DNA
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcct

SEQ ID NO: 15995 - DNA, 306 bp, synthetic construct
  misc_feature 1..306: note = Synthetic polypeptide
  source 1..306: mol_type = other DNA
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatcc

SEQ ID NO: 15996 - DNA, 1005 bp, synthetic construct
  misc_feature 1..1005: note = Synthetic polypeptide
  source 1..1005: mol_type = other DNA
ctccttccacggtctccctctgatgccgagccaaagctggacggtactgctgccatctcggctcactgcaacctccctgcctgattctcctgcctcagcctgccgagtgccgccacgcctgactggttttcgttttttttttggtggagacggggttttgctgtgttggccgggctggtctccagctcctaaccgcgagtgatccgccagcctcggcctccctaggtgccgggattgcagacggagtctcgttcactcagtgctcaatggtgcccaggctggagtgcagtggcgtgatctcggctcgctacaaccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttcgccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaactctctgcctggcaaccgccccgtctgagaagtgaggagcccctccgtccggcagccatcccgtctgggaagtgaggagcccctccgcctggcagccaccccgtctggaaacggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatag

SEQ ID NO: 15997 - DNA, 914 bp, synthetic construct
  misc_feature 1..914: note = Synthetic polypeptide
  source 1..914: mol_type = other DNA
ctccttccacggtctccctctgatgccgagccaaagctggacggtactgctgccatctcggctcactgcaacctccctgcctgattctcctgcctcagcctgccgagtgccgccacgcctgactggttttcgttttttttttggtggagacggggttttgctgtgttggccgggctggtctccagctcctaaccgcgagtgatccgccagcctcggcctccctaggtgccgggattgcagacggagtctcgttcactcagtgctcaatggtgcccaggctggagtgcagtggcgtgatctcggctcgctacaaccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttcgccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaactctctgcctggcaaccgccccgtctgagaagtgaggagcccctccgtccggcagccatcccgtctgggaagtgaggagcccctccgcctggcagccaccccgtctggaaacggatctgaaaagaacaattgctgtccttctggatgacattttgcaacgattggtgaagctggagaacaaagttgactatattgttgtgaatgg

SEQ ID NO: 15998 - DNA, 2448 bp, synthetic construct; identical to SEQ ID NO: 6618
  misc_feature 1..2448: note = Synthetic polypeptide
  source 1..2448: mol_type = other DNA

SEQ ID NO: 15999 - DNA, 1543 bp, synthetic construct; identical to SEQ ID NO: 6619
  misc_feature 1..1543: note = Synthetic polypeptide
  source 1..1543: mol_type = other DNA

SEQ ID NO: 16000 - DNA, 1468 bp, synthetic construct; identical to SEQ ID NO: 6620
  misc_feature 1..1468: note = Synthetic polypeptide
  source 1..1468: mol_type = other DNA

SEQ ID NO: 16001 - DNA, 863 bp, synthetic construct
  misc_feature 1..863: note = Synthetic polypeptide
  source 1..863: mol_type = other DNA
tttgcagagagttttaaaaacaaaagaaaatgcctgtggcattatgttgactggaaaaaacaagttccacattgtatatatgggatgttctcaactgtgcttaagtctggaaggaaatctgccaggaggttgacagtagctgcttctagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaag

SEQ ID NO: 16002 - DNA, 2174 bp, synthetic construct
  misc_feature 1..2174: note = Synthetic polypeptide
  source 1..2174: mol_type = other DNA
tttgcagagagttttaaaaacaaaagaaaatgcctgtggcattatgttgactggaaaaaacaagttccacattgtatatatgggatgttctcaactgtgcttaagtctggaaggaaatctgccaggaggttgacagtagctgcttctagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaa

SEQ ID NO: 16003 - DNA, 625 bp, synthetic construct; identical to SEQ ID NO: 6804
  misc_feature 1..625: note = Synthetic polypeptide
  source 1..625: mol_type = other DNA

SEQ ID NO: 16004 - DNA, 598 bp, synthetic construct; identical to SEQ ID NO: 6805
  misc_feature 1..598: note = Synthetic polypeptide
  source 1..598: mol_type = other DNA

SEQ ID NO: 16005 - DNA, 119 bp, synthetic construct; identical to SEQ ID NO: 6582
  misc_feature 1..119: note = Synthetic polypeptide
  source 1..119: mol_type = other DNA

SEQ ID NO: 16006 - DNA, 462 bp, synthetic construct
  misc_feature 1..462: note = Synthetic polypeptide
  source 1..462: mol_type = other DNA
ggctggatgctgtggctcacgcctgtaatctcagcactttgggaggcagaggcaggcagattacctgaggttgggagttcgagaccagcctgaccaacatggagaaaccccgtctctactaaaaatacaagatagccaggcgtggtggcacatgcctgtaatcccagctactcggtaggctgaagcaggagaagaatcacttgaactcgggaggcggaggttgcagtgagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctga

SEQ ID NO: 16007 - DNA, 612 bp, synthetic construct
  misc_feature 1..612: note = Synthetic polypeptide
  source 1..612: mol_type = other DNA
ggctggatgctgtggctcacgcctgtaatctcagcactttgggaggcagaggcaggcagattacctgaggttgggagttcgagaccagcctgaccaacatggagaaaccccgtctctactaaaaatacaagatagccaggcgtggtggcacatgcctgtaatcccagctactcggtaggctgaagcaggagaagaatcacttgaactcgggaggcggaggttgcagtgagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaa

SEQ ID NO: 16008 - DNA, 1767 bp, synthetic construct; identical to SEQ ID NO: 7857
  misc_feature 1..1767: note = Synthetic polypeptide
  source 1..1767: mol_type = other DNA

SEQ ID NO: 16009 - DNA, 1764 bp, synthetic construct; identical to SEQ ID NO: 7858
  misc_feature 1..1764: note = Synthetic polypeptide
  source 1..1764: mol_type = other DNA

SEQ ID NO: 16010 - DNA, 630 bp, synthetic construct; identical to SEQ ID NO: 7859
  misc_feature 1..630: note = Synthetic polypeptide
  source 1..630: mol_type = other DNA

SEQ ID NO: 16011 - DNA, 303 bp, synthetic construct
  misc_feature 1..303: note = Synthetic polypeptide
  source 1..303: mol_type = other DNA
agtgaagagcacagattgagtcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctga

SEQ ID NO: 16012 - DNA, 519 bp, synthetic construct
  misc_feature 1..519: note = Synthetic polypeptide
  source 1..519: mol_type = other DNA
tttgggttcatgttgcctgcattttggtccacgtggctctgtttaatacctgtgtgaccttgtgcaagtctcttaacctctaacctcttgcgcccttagccatacctgtcttgtcggattgctttgaggatgaatgaagcagctgtgtttcgacacttagtgcctggcgtatactgccttggggtgcggtgcaggggtccagagccatgtcggacctgttactgttactactggacctgactctgttactgctgctgatgctgctgggctttgccgggtactcagggcagttggctggggtggcagtgagtgccggctcaccccccatccctacaagttccatgtggagccctatggtgagactgggtggcttctcaccagagctgcagcatctcccccaaactctgctccatcgctgtccactaggacaaccctgcatgggagtgttgacatttagggatgtggccttagaattctctctggaggagtggcaatgcctggacaccgcacagcagaatt

SEQ ID NO: 16013 - DNA, 462 bp, synthetic construct
  misc_feature 1..462: note = Synthetic polypeptide
  source 1..462: mol_type = other DNA
gaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaa

SEQ ID NO: 16014 - DNA, 2099 bp, synthetic construct
  misc_feature 1..2099: note = Synthetic polypeptide
  source 1..2099: mol_type = other DNA
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataa

SEQ ID NO: 16015 - DNA, 1433 bp, synthetic construct
  misc_feature 1..1433: note = Synthetic polypeptide
  source 1..1433: mol_type = other DNA
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttga

SEQ ID NO: 16016 - DNA, 2039 bp, synthetic construct
  misc_feature 1..2039: note = Synthetic polypeptide
  source 1..2039: mol_type = other DNA
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattag

SEQ ID NO: 16017 - DNA, 376 bp, synthetic construct; identical to SEQ ID NO: 10759
  misc_feature 1..376: note = Synthetic polypeptide
  source 1..376: mol_type = other DNA

SEQ ID NO: 16018 - DNA, 2167 bp, synthetic construct
  misc_feature 1..2167: note = Synthetic polypeptide
  source 1..2167: mol_type = other DNA
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16019 - DNA, 1942 bp, synthetic construct
  misc_feature 1..1942: note = Synthetic polypeptide
  source 1..1942: mol_type = other DNA
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16020 - DNA, 2110 bp, synthetic construct
  misc_feature 1..2110: note = Synthetic polypeptide
  source 1..2110: mol_type = other DNA
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16021 - DNA, 2113 bp, synthetic construct
  misc_feature 1..2113: note = Synthetic polypeptide
  source 1..2113: mol_type = other DNA
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16022 - DNA, 1999 bp, synthetic construct
  misc_feature 1..1999: note = Synthetic polypeptide
  source 1..1999: mol_type = other DNA
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16023 - DNA, 1002 bp, synthetic construct
  misc_feature 1..1002: note = Synthetic polypeptide
  source 1..1002: mol_type = other DNA
ctctcccctctcccttttctcctctcccctctccctctcggtctccctctccctctctttccactgtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgcctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccatctgggatgtgaggagcgcctctgccaggccgcgaccccgtctgggaggtgaggagcgtctctgcccagccgccccgtctgagaagtgaggagaccctccgcccagcatccgccccatctgagaagtgaggagcccctccgcccggcagctgccccgtctgagaagtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaa

SEQ ID NO: 16024 - DNA, 455 bp, synthetic construct; identical to SEQ ID NO: 7734
  misc_feature 1..455: note = Synthetic polypeptide
  source 1..455: mol_type = other DNA

SEQ ID NO: 16025 - DNA, 873 bp, synthetic construct; identical to SEQ ID NO: 6614
  misc_feature 1..873: note = Synthetic polypeptide
  source 1..873: mol_type = other DNA

SEQ ID NO: 16026 - DNA, 207 bp, synthetic construct; identical to SEQ ID NO: 6615
  misc_feature 1..207: note = Synthetic polypeptide
  source 1..207: mol_type = other DNA

SEQ ID NO: 16027 - DNA, 2231 bp, synthetic construct
  misc_feature 1..2231: note = Synthetic polypeptide
  source 1..2231: mol_type = other DNA
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16028 - DNA, 2006 bp, synthetic construct
  misc_feature 1..2006: note = Synthetic polypeptide
  source 1..2006: mol_type = other DNA
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16029 - DNA, 2174 bp, synthetic construct
  misc_feature 1..2174: note = Synthetic polypeptide
  source 1..2174: mol_type = other DNA
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16030 - DNA, 2177 bp, synthetic construct
  misc_feature 1..2177: note = Synthetic polypeptide
  source 1..2177: mol_type = other DNA
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16031 - DNA, 2063 bp, synthetic construct
  misc_feature 1..2063: note = Synthetic polypeptide
  source 1..2063: mol_type = other DNA
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16032 - DNA, 60 bp, synthetic construct
  misc_feature 1..60: note = Synthetic polypeptide
  source 1..60: mol_type = other DNA
catgctcctccacaggtcaacaggaagggatacatctactcaacaaacttcgggatttag

SEQ ID NO: 16033 - DNA, 3364 bp, synthetic construct
  misc_feature 1..3364: note = Synthetic polypeptide
  source 1..3364: mol_type = other DNA
ggctgggtgcagtggcttacgtctgtaattccagcactttggaaagctgagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaa

SEQ ID NO: 16034 - DNA, 478 bp, synthetic construct
  misc_feature 1..478: note = Synthetic polypeptide
  source 1..478: mol_type = other DNA
ggctgggtgcagtggcttacgtctgtaattccagcactttggaaagctgagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcag

SEQ ID NO: 16035 - DNA, 369 bp, synthetic construct; identical to SEQ ID NO: 6492
  misc_feature 1..369: note = Synthetic polypeptide
  source 1..369: mol_type = other DNA

SEQ ID NO: 16036 - DNA, 4908 bp, synthetic construct; identical to SEQ ID NO: 11516
  misc_feature 1..4908: note = Synthetic polypeptide
  source 1..4908: mol_type = other DNA

SEQ ID NO: 16037 - DNA, 4611 bp, synthetic construct; identical to SEQ ID NO: 11517
  misc_feature 1..4611: note = Synthetic polypeptide
  source 1..4611: mol_type = other DNA

SEQ ID NO: 16038 - DNA, 5142 bp, synthetic construct; identical to SEQ ID NO: 11518
  misc_feature 1..5142: note = Synthetic polypeptide
  source 1..5142: mol_type = other DNA

SEQ ID NO: 16039 - DNA, 777 bp, synthetic construct; identical to SEQ ID NO: 11519
  misc_feature 1..777: note = Synthetic polypeptide
  source 1..777: mol_type = other DNA

SEQ ID NO: 16040 - DNA, 1018 bp, synthetic construct
  misc_feature 1..1018: note = Synthetic polypeptide
  source 1..1018: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16041 - DNA, 1807 bp, synthetic construct
  misc_feature 1..1807: note = Synthetic polypeptide
  source 1..1807: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16042 - DNA, 2434 bp, synthetic construct
  misc_feature 1..2434: note = Synthetic polypeptide
  source 1..2434: mol_type = other DNA
gagctgcaggcttgggagtcccacctgcctgcttttgaatcctgtcaagactgtggcttggcacccttgggcatgtgatgtgaccttcctgagcctgcattccctcacctggaaatgatgagcagttactgatgccacagatttggggaagagcctgtgaggtcatgagtgtgcaggccaggctgagcgctctgcgaatattcactggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctga

SEQ ID NO: 16043 - DNA, 382 bp, synthetic construct; identical to SEQ ID NO: 434
  misc_feature 1..382: note = Synthetic polypeptide
  source 1..382: mol_type = other DNA

SEQ ID NO: 16044 - DNA, 330 bp, synthetic construct; identical to SEQ ID NO: 7604
  misc_feature 1..330: note = Synthetic polypeptide
  source 1..330: mol_type = other DNA

SEQ ID NO: 16045 - DNA, 1516 bp, synthetic construct; identical to SEQ ID NO: 534
  misc_feature 1..1516: note = Synthetic polypeptide
  source 1..1516: mol_type = other DNA

SEQ ID NO: 16046 - DNA, 591 bp, synthetic construct; identical to SEQ ID NO: 539
  misc_feature 1..591: note = Synthetic polypeptide
  source 1..591: mol_type = other DNA

SEQ ID NO: 16047 - DNA, 482 bp, synthetic construct; identical to SEQ ID NO: 540
  misc_feature 1..482: note = Synthetic polypeptide
  source 1..482: mol_type = other DNA

SEQ ID NO: 16048 - DNA, 444 bp, synthetic construct; identical to SEQ ID NO: 541
  misc_feature 1..444: note = Synthetic polypeptide
  source 1..444: mol_type = other DNA

SEQ ID NO: 16049 - DNA, 334 bp, synthetic construct; identical to SEQ ID NO: 533
  misc_feature 1..334: note = Synthetic polypeptide
  source 1..334: mol_type = other DNA

SEQ ID NO: 16050 - DNA, 38 bp, synthetic construct; identical to SEQ ID NO: 543
  misc_feature 1..38: note = Synthetic polypeptide
  source 1..38: mol_type = other DNA

SEQ ID NO: 16051 - DNA, 245 bp, synthetic construct; identical to SEQ ID NO: 542
  misc_feature 1..245: note = Synthetic polypeptide
  source 1..245: mol_type = other DNA

SEQ ID NO: 16052 - DNA, 1218 bp, synthetic construct; identical to SEQ ID NO: 8394
  misc_feature 1..1218: note = Synthetic polypeptide
  source 1..1218: mol_type = other DNA

SEQ ID NO: 16053 - DNA, 1053 bp, synthetic construct; identical to SEQ ID NO: 8395
  misc_feature 1..1053: note = Synthetic polypeptide
  source 1..1053: mol_type = other DNA

SEQ ID NO: 16054 - DNA, 942 bp, synthetic construct; identical to SEQ ID NO: 8396
  misc_feature 1..942: note = Synthetic polypeptide
  source 1..942: mol_type = other DNA

SEQ ID NO: 16055 - DNA, 1091 bp, synthetic construct; identical to SEQ ID NO: 8397
  misc_feature 1..1091: note = Synthetic polypeptide
  source 1..1091: mol_type = other DNA

SEQ ID NO: 16056 - DNA, 926 bp, synthetic construct
  misc_feature 1..926: note = Synthetic polypeptide
  source 1..926: mol_type = other DNA
ggctgggcgtggtggctcacacctgtaatcccagcactttgggaggccgaggcaggcagatcacgaggccaggagttcgagaccagcctagccaacatggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtag

SEQ ID NO: 16057 - DNA, 1145 bp, synthetic construct
  misc_feature 1..1145: note = Synthetic polypeptide
  source 1..1145: mol_type = other DNA
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaa

SEQ ID NO: 16058 - DNA, 560 bp, synthetic construct
  misc_feature 1..560: note = Synthetic polypeptide
  source 1..560: mol_type = other DNA
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactga

SEQ ID NO: 16059 - DNA, 575 bp, synthetic construct
  misc_feature 1..575: note = Synthetic polypeptide
  source 1..575: mol_type = other DNA
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataa

SEQ ID NO: 16060 - DNA, 1714 bp, synthetic construct
  misc_feature 1..1714: note = Synthetic polypeptide
  source 1..1714: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 16061 - DNA, 1600 bp, synthetic construct
  misc_feature 1..1600: note = Synthetic polypeptide
  source 1..1600: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 16062 - DNA, 833 bp, synthetic construct
  misc_feature 1..833: note = Synthetic polypeptide
  source 1..833: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 16063 - DNA, 779 bp, synthetic construct
  misc_feature 1..779: note = Synthetic polypeptide
  source 1..779: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacc

SEQ ID NO: 16064 - DNA, 570 bp, synthetic construct
  misc_feature 1..570: note = Synthetic polypeptide
  source 1..570: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaa

SEQ ID NO: 16065 - DNA, 538 bp, synthetic construct
  misc_feature 1..538: note = Synthetic polypeptide
  source 1..538: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacatt

SEQ ID NO: 16066 - DNA, 559 bp, synthetic construct
  misc_feature 1..559: note = Synthetic polypeptide
  source 1..559: mol_type = other DNA
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 16067 - DNA, 415 bp, synthetic construct
  misc_feature 1..415: note = Synthetic polypeptide
  source 1..415: mol_type = other DNA
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaaccctag

SEQ ID NO: 16068 - DNA, 1477 bp, synthetic construct
  misc_feature 1..1477: note = Synthetic polypeptide
  source 1..1477: mol_type = other DNA
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaa

SEQ ID NO: 16069 - DNA, 1384 bp, synthetic construct
  misc_feature 1..1384: note = Synthetic polypeptide
  source 1..1384: mol_type = other DNA
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactag

SEQ ID NO: 16070 - DNA, 1184 bp, synthetic construct
  misc_feature 1..1184: note = Synthetic polypeptide
  source 1..1184: mol_type = other DNA
aaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtag

SEQ ID NO: 16071 - DNA, 332 bp, synthetic construct
  misc_feature 1..332: note = Synthetic polypeptide
  source 1..332: mol_type = other DNA
aaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctga

SEQ ID NO: 16072 - DNA, 1131 bp, synthetic construct
  misc_feature 1..1131: note = Synthetic polypeptide
  source 1..1131: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16073 - DNA, 1188 bp, synthetic construct
  misc_feature 1..1188: note = Synthetic polypeptide
  source 1..1188: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16074 - DNA, 329 bp, synthetic construct
  misc_feature 1..329: note = Synthetic polypeptide
  source 1..329: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctgg

SEQ ID NO: 16075 - DNA, 1083 bp, synthetic construct
  misc_feature 1..1083: note = Synthetic polypeptide
  source 1..1083: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16076 - DNA, 288 bp, synthetic construct
  misc_feature 1..288: note = Synthetic polypeptide
  source 1..288: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgct

SEQ ID NO: 16077 - DNA, 177 bp, synthetic construct
  misc_feature 1..177: note = Synthetic polypeptide
  source 1..177: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcct

SEQ ID NO: 16078 - DNA, 1239 bp, synthetic construct
  misc_feature 1..1239: note = Synthetic polypeptide
  source 1..1239: mol_type = other DNA
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16079 - DNA, 2019 bp, synthetic construct
  misc_feature 1..2019: note = Synthetic polypeptide
  source 1..2019: mol_type = other DNA
ccccagacctctcacccaggaccccaagtgtgcacctttgaagccattgtcttcactcctgactgatagatcggggatccaatggtgagtcagactaacgaaccattgctccggacaaacatctgttgaagctggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatga

SEQ ID NO: 16080 - DNA, 776 bp, synthetic construct; identical to SEQ ID NO: 7522
  misc_feature 1..776: note = Synthetic polypeptide
  source 1..776: mol_type = other DNA

SEQ ID NO: 16081 - DNA, 548 bp, synthetic construct; identical to SEQ ID NO: 7523
  misc_feature 1..548: note = Synthetic polypeptide
  source 1..548: mol_type = other DNA

SEQ ID NO: 16082 - DNA, 957 bp, synthetic construct
  misc_feature 1..957: note = Synthetic polypeptide
  source 1..957: mol_type = other DNA
ctctccctctccctctccctctccctctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcacgcgccgccacgcctgattggttttggtggagacggggtttcgctgtgttggccgggccggtctccagcccctaaccgcgagtgatccgccaacctcggcctcccgaggtgccgggattgcagatggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcccggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaatcctcctgcatatgcccaagaggattgggagtggaatggacaccagcagaagcaccacagttattcctgtag

SEQ ID NO: 16083 - DNA, 1010 bp, synthetic construct
  misc_feature 1..1010: note = Synthetic polypeptide
  source 1..1010: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16084 - DNA, 1076 bp, synthetic construct
  misc_feature 1..1076: note = Synthetic polypeptide
  source 1..1076: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16085 - DNA, 1145 bp, synthetic construct
  misc_feature 1..1145: note = Synthetic polypeptide
  source 1..1145: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16086 - DNA, 1004 bp, synthetic construct
  misc_feature 1..1004: note = Synthetic polypeptide
  source 1..1004: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16087 - DNA, 1477 bp, synthetic construct; identical to SEQ ID NO: 15352
  misc_feature 1..1477: note = Synthetic polypeptide
  source 1..1477: mol_type = other DNA

SEQ ID NO: 16088 - DNA, 1600 bp, synthetic construct; identical to SEQ ID NO: 15353
  misc_feature 1..1600: note = Synthetic polypeptide
  source 1..1600: mol_type = other DNA

SEQ ID NO: 16089 - DNA, 1390 bp, synthetic construct; identical to SEQ ID NO: 15354
  misc_feature 1..1390: note = Synthetic polypeptide
  source 1..1390: mol_type = other DNA

SEQ ID NO: 16090 - DNA, 1423 bp, synthetic construct; identical to SEQ ID NO: 15355
  misc_feature 1..1423: note = Synthetic polypeptide
  source 1..1423: mol_type = other DNA

SEQ ID NO: 16091 - DNA, 1134 bp, synthetic construct
  misc_feature 1..1134: note = Synthetic polypeptide
  source 1..1134: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 16092 - DNA, 969 bp, synthetic construct
  misc_feature 1..969: note = Synthetic polypeptide
  source 1..969: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 16093 - DNA, 858 bp, synthetic construct
  misc_feature 1..858: note = Synthetic polypeptide
  source 1..858: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 16094 - DNA, 1007 bp, synthetic construct
  misc_feature 1..1007: note = Synthetic polypeptide
  source 1..1007: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 16095 - DNA, 132 bp, synthetic construct
  misc_feature 1..132: note = Synthetic polypeptide
  source 1..132: mol_type = other DNA
tctgttccaagatgactgaatagaaacagctccggtctgcagctcccagcgtgattgacgcagaagacgggtgatttctgcatttccaactgagatactcagagtggaagtaagaatgaggaagatagatag

SEQ ID NO: 16096 - DNA, 441 bp, synthetic construct
  misc_feature 1..441: note = Synthetic polypeptide
  source 1..441: mol_type = other DNA
tctgttccaagatgactgaatagaaacagctccggtctgcagctcccagcgtgattgacgcagaagacgggtgatttctgcatttccaactgagatactcagagtggaaatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaa

SEQ ID NO: 16097 - DNA, 1133 bp, synthetic construct; identical to SEQ ID NO: 7332
  misc_feature 1..1133: note = Synthetic polypeptide
  source 1..1133: mol_type = other DNA

SEQ ID NO: 16098 - DNA, 1172 bp, synthetic construct; identical to SEQ ID NO: 7333
  misc_feature 1..1172: note = Synthetic polypeptide
  source 1..1172: mol_type = other DNA

SEQ ID NO: 16099 - DNA, 399 bp, synthetic construct; identical to SEQ ID NO: 10344
  misc_feature 1..399: note = Synthetic polypeptide
  source 1..399: mol_type = other DNA

SEQ ID NO: 16100 - DNA, 138 bp, synthetic construct; identical to SEQ ID NO: 10345
  misc_feature 1..138: note = Synthetic polypeptide
  source 1..138: mol_type = other DNA

SEQ ID NO: 16101 - DNA, 589 bp, synthetic construct
  misc_feature 1..589: note = Synthetic polypeptide
  source 1..589: mol_type = other DNA
ggctaggcattatagctcatacctgtaatccaaacactttaggaggtgaaggtgggaggattgcttcagtccaagagtttgagaccagcatgggcaacatagtgagaccctgtctgtataaaagaaacaagttagccaggtgtggcggcaagtgcctgtagtccccgctacgcaggaggctgagctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtga

SEQ ID NO: 16102 - DNA, 1532 bp, synthetic construct; identical to SEQ ID NO: 14790
  misc_feature 1..1532: note = Synthetic polypeptide
  source 1..1532: mol_type = other DNA

SEQ ID NO: 16103 - DNA, 1466 bp, synthetic construct; identical to SEQ ID NO: 14791
  misc_feature 1..1466: note = Synthetic polypeptide
  source 1..1466: mol_type = other DNA

SEQ ID NO: 16104 - DNA, 147 bp, synthetic construct; identical to SEQ ID NO: 6327
  misc_feature 1..147: note = Synthetic polypeptide
  source 1..147: mol_type = other DNA

SEQ ID NO: 16105 - DNA, 2400 bp, synthetic construct
  misc_feature 1..2400: note = Synthetic polypeptide
  source 1..2400: mol_type = other DNA
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16106 - DNA, 974 bp, synthetic construct; identical to SEQ ID NO: 9598
  misc_feature 1..974: note = Synthetic polypeptide
  source 1..974: mol_type = other DNA

SEQ ID NO: 16107 - DNA, 118 bp, synthetic construct; identical to SEQ ID NO: 7912
  misc_feature 1..118: note = Synthetic polypeptide
  source 1..118: mol_type = other DNA

SEQ ID NO: 16108 - DNA, 435 bp, synthetic construct; identical to SEQ ID NO: 7913
  misc_feature 1..435: note = Synthetic polypeptide
  source 1..435: mol_type = other DNA

SEQ ID NO: 16109 - DNA, 519 bp, synthetic construct; identical to SEQ ID NO: 7914
  misc_feature 1..519: note = Synthetic polypeptide
  source 1..519: mol_type = other DNA

SEQ ID NO: 16110 - DNA, 480 bp, synthetic construct; identical to SEQ ID NO: 7915
  misc_feature 1..480: note = Synthetic polypeptide
  source 1..480: mol_type = other DNA

SEQ ID NO: 16111 - DNA, 597 bp, synthetic construct; identical to SEQ ID NO: 7916
  misc_feature 1..597: note = Synthetic polypeptide
  source 1..597: mol_type = other DNA

SEQ ID NO: 16112 - DNA, 423 bp, synthetic construct
  misc_feature 1..423: note = Synthetic polypeptide
  source 1..423: mol_type = other DNA
gagctgttaaaagagagggtagatgggctgccttggttgatggtatattccttgctcatcagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaa

SEQ ID NO: 16113 - DNA, 771 bp, synthetic construct; identical to SEQ ID NO: 9426
  misc_feature 1..771: note = Synthetic polypeptide
  source 1..771: mol_type = other DNA

SEQ ID NO: 16114 - DNA, 1249 bp, synthetic construct; identical to SEQ ID NO: 7981
  misc_feature 1..1249: note = Synthetic polypeptide
  source 1..1249: mol_type = other DNA

SEQ ID NO: 16115 - DNA, 472 bp, synthetic construct; identical to SEQ ID NO: 7982
  misc_feature 1..472: note = Synthetic polypeptide
  source 1..472: mol_type = other DNA

SEQ ID NO: 16116 - DNA, 1195 bp, synthetic construct; identical to SEQ ID NO: 7983
  misc_feature 1..1195: note = Synthetic polypeptide
  source 1..1195: mol_type = other DNA

SEQ ID NO: 16117 - DNA, 709 bp, synthetic construct; identical to SEQ ID NO: 7984
  misc_feature 1..709: note = Synthetic polypeptide
  source 1..709: mol_type = other DNA

SEQ ID NO: 16118 - DNA, 1144 bp, synthetic construct; identical to SEQ ID NO: 7985
  misc_feature 1..1144: note = Synthetic polypeptide
  source 1..1144: mol_type = other DNA

SEQ ID NO: 16119 - DNA, 685 bp, synthetic construct; identical to SEQ ID NO: 7986
  misc_feature 1..685: note = Synthetic polypeptide
  source 1..685: mol_type = other DNA

SEQ ID NO: 16120 - DNA, 538 bp, synthetic construct; identical to SEQ ID NO: 7987
  misc_feature 1..538: note = Synthetic polypeptide
  source 1..538: mol_type = other DNA

SEQ ID NO: 16121 - DNA, 446 bp, synthetic construct; identical to SEQ ID NO: 7988
  misc_feature 1..446: note = Synthetic polypeptide
  source 1..446: mol_type = other DNA

SEQ ID NO: 16122 - DNA, 599 bp, synthetic construct; identical to SEQ ID NO: 7989
  misc_feature 1..599: note = Synthetic polypeptide
  source 1..599: mol_type = other DNA

SEQ ID NO: 16123 - DNA, 448 bp, synthetic construct; identical to SEQ ID NO: 7990
  misc_feature 1..448: note = Synthetic polypeptide
  source 1..448: mol_type = other DNA

SEQ ID NO: 16124 - DNA, 67 bp, synthetic construct
  misc_feature 1..67: note = Synthetic polypeptide
  source 1..67: mol_type = other DNA
tccaaaaacaacagacgcatgttggcaagagtacagagacaagggaatgcttatacactgttggtga

SEQ ID NO: 16125 - DNA, 1883 bp, synthetic construct; identical to SEQ ID NO: 6345
  misc_feature 1..1883: note = Synthetic polypeptide
  source 1..1883: mol_type = other DNA

SEQ ID NO: 16126 - DNA, 1073 bp, synthetic construct
  misc_feature 1..1073: note = Synthetic polypeptide
  source 1..1073: mol_type = other DNA
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctga

SEQ ID NO: 16127 - DNA, 620 bp, synthetic construct
  misc_feature 1..620: note = Synthetic polypeptide
  source 1..620: mol_type = other DNA
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtga

SEQ ID NO: 16128 - DNA, 592 bp, synthetic construct
  misc_feature 1..592: note = Synthetic polypeptide
  source 1..592: mol_type = other DNA
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggcca

SEQ ID NO: 16129 - DNA, 2109 bp, synthetic construct; identical to SEQ ID NO: 14945
  misc_feature 1..2109: note = Synthetic polypeptide
  source 1..2109: mol_type = other DNA

SEQ ID NO: 16130 - DNA, 379 bp, synthetic construct; identical to SEQ ID NO: 12764
  misc_feature 1..379: note = Synthetic polypeptide
  source 1..379: mol_type = other DNA

SEQ ID NO: 16131 - DNA, 280 bp, synthetic construct; identical to SEQ ID NO: 12765
  misc_feature 1..280: note = Synthetic polypeptide
  source 1..280: mol_type = other DNA

SEQ ID NO: 16132 - DNA, 970 bp, synthetic construct
  misc_feature 1..970: note = Synthetic polypeptide
  source 1..970: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16133 - DNA, 1036 bp, synthetic construct
  misc_feature 1..1036: note = Synthetic polypeptide
  source 1..1036: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16134 - DNA, 1105 bp, synthetic construct
  misc_feature 1..1105: note = Synthetic polypeptide
  source 1..1105: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16135 - DNA, 964 bp, synthetic construct
  misc_feature 1..964: note = Synthetic polypeptide
  source 1..964: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16136 - DNA, 1973 bp, synthetic construct
  misc_feature 1..1973: note = Synthetic polypeptide
  source 1..1973: mol_type = other DNA
tgatattgtgacgtaataataagaaacatgcttttggtctctggccctggttctgggcacacagctcctacaacctttagtgctgagtgtctttttgtttgctaatgaggtgactgtggcgggccccaggacaacctcctgggggactggttgccagggcaaccgaccacgtgattagaggttgggactccacccgtggacctctggggaggggagggagcccgcagaggtggagtggatcaccagtggccggtgttctgctcgatcgtgcctgtgtaatgaggcctccacagactccctcaacgacagcgtttgggggcttgcaggctgctgagcacggggaggttcccggagggtggagccctggcgagggcacagcagctccgagctccctgccccatacctcgccctgtgcatctcttcatctgtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtga

SEQ ID NO: 16137 - DNA, 1500 bp, synthetic construct; identical to SEQ ID NO: 9786
  misc_feature 1..1500: note = Synthetic polypeptide
  source 1..1500: mol_type = other DNA

SEQ ID NO: 16138 - DNA, 1483 bp, synthetic construct
  misc_feature 1..1483: note = Synthetic polypeptide
  source 1..1483: mol_type = other DNA
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16139 - DNA, 1636 bp, synthetic construct
  misc_feature 1..1636: note = Synthetic polypeptide
  source 1..1636: mol_type = other DNA
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16140 - DNA, 1606 bp, synthetic construct
  misc_feature 1..1606: note = Synthetic polypeptide
  source 1..1606: mol_type = other DNA
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16141 - DNA, 251 bp, synthetic construct; identical to SEQ ID NO: 10592
  misc_feature 1..251: note = Synthetic polypeptide
  source 1..251: mol_type = other DNA

SEQ ID NO: 16142 - DNA, 448 bp, synthetic construct
  misc_feature 1..448: note = Synthetic polypeptide
  source 1..448: mol_type = other DNA
tgatatggcttggccgtgtccccacccagatcttatcttgaattgtagttcccataatccccttgtctcatgggagggacctggtaggaggtaattgaatcatgggggcggttactctcatgccattctcatcatgatagtaagtgagatctcataagatcagatggttttataaggggcttttctccctttgctcggcacttctctctcctgccaccttgtgaagaaggatgtgtttgcttccgcttccaccatgattatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtag

SEQ ID NO: 16143 - DNA, 285 bp, synthetic construct
  misc_feature 1..285: note = Synthetic polypeptide
  source 1..285: mol_type = other DNA
tgatatggcttggccgtgtccccacccagatcttatcttgaattgtagttcccataatccccttgtctcatgggagggacctggtaggaggtaattgaatcatgggggcggttactctcatgccattctcatcatgatagtaagtgagatctcataagatcagatggttttataaggggcttttctccctttgctcggcacttctctctcctgccaccttgtgaagaaggatgtgtttgcttccgcttccaccatgattatcttcccagacccgtcagattttga

SEQ ID NO: 16144 - DNA, 618 bp, synthetic construct; identical to SEQ ID NO: 9652
  misc_feature 1..618: note = Synthetic polypeptide
  source 1..618: mol_type = other DNA

SEQ ID NO: 16145 - DNA, 418 bp, synthetic construct; identical to SEQ ID NO: 14823
  misc_feature 1..418: note = Synthetic polypeptide
  source 1..418: mol_type = other DNA

SEQ ID NO: 16146 - DNA, 2702 bp, synthetic construct
  misc_feature 1..2702: note = Synthetic polypeptide
  source 1..2702: mol_type = other DNA
ccacttggactgtgaagttctaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 16147 - DNA, 2684 bp, synthetic construct
  misc_feature 1..2684: note = Synthetic polypeptide
  source 1..2684: mol_type = other DNA
ccacttggactgtgaagttctaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 16148 - DNA, 853 bp, synthetic construct; identical to SEQ ID NO: 8074
  misc_feature 1..853: note = Synthetic polypeptide
  source 1..853: mol_type = other DNA

SEQ ID NO: 16149 - DNA, 842 bp, synthetic construct; identical to SEQ ID NO: 6534
  misc_feature 1..842: note = Synthetic polypeptide
  source 1..842: mol_type = other DNA

SEQ ID NO: 16150 - DNA, 507 bp, synthetic construct
  misc_feature 1..507: note = Synthetic polypeptide
  source 1..507: mol_type = other DNA
gccataattgacaattatttgatatgcctccatcaagggaagaaatttccctctccttgaatccaggcatgcttgtgactactttgaccaatcgagttcagcagaagtgatgctttcaaggcttgatctaaaagggtcatacaatctcctgtttgtttgctgtaaccctcactcttggaccctgagatcccatgtaagaagtcctgctactctgcatgaagcccaagccacatggaaggatcatgtgggtgctttggttgacagccccagataaacccagccttcaggtgccacccatgagtgaaaaagcttccagatcccaccaccctaaacattcaagtcttctcaggtgaactctcaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaa

SEQ ID NO: 16151 - DNA, 1016 bp, synthetic construct; identical to SEQ ID NO: 6795
  misc_feature 1..1016: note = Synthetic polypeptide
  source 1..1016: mol_type = other DNA

SEQ ID NO: 16152 - DNA, 1187 bp, synthetic construct; identical to SEQ ID NO: 6796
  misc_feature 1..1187: note = Synthetic polypeptide
  source 1..1187: mol_type = other DNA

SEQ ID NO: 16153 - DNA, 965 bp, synthetic construct; identical to SEQ ID NO: 6797
  misc_feature 1..965: note = Synthetic polypeptide
  source 1..965: mol_type = other DNA

SEQ ID NO: 16154 - DNA, 2471 bp, synthetic construct; identical to SEQ ID NO: 576
  misc_feature 1..2471: note = Synthetic polypeptide
  source 1..2471: mol_type = other DNA

SEQ ID NO: 16155 - DNA, 1860 bp, synthetic construct
  misc_feature 1..1860: note = Synthetic polypeptide
  source 1..1860: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 16156 - DNA, 1083 bp, synthetic construct
  misc_feature 1..1083: note = Synthetic polypeptide
  source 1..1083: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggatgataacaccctatgcccattgtcctgatctgaaaattcttggaaattgttccatgtga

SEQ ID NO: 16157 - DNA, 1806 bp, synthetic construct
  misc_feature 1..1806: note = Synthetic polypeptide
  source 1..1806: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 16158 - DNA, 1320 bp, synthetic construct
  misc_feature 1..1320: note = Synthetic polypeptide
  source 1..1320: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctga

SEQ ID NO: 16159 - DNA, 1755 bp, synthetic construct
  misc_feature 1..1755: note = Synthetic polypeptide
  source 1..1755: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 16160 - DNA, 1296 bp, synthetic construct
  misc_feature 1..1296: note = Synthetic polypeptide
  source 1..1296: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaa

SEQ ID NO: 16161 - DNA, 1149 bp, synthetic construct
  misc_feature 1..1149: note = Synthetic polypeptide
  source 1..1149: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcagggctggagtgcaatggcgcgatcttggctcaccgcaacctccgcctcccgggttcaagcgattctcccacctcagcctcccaagtagctgggattacaggaatgtgccaccacgcccggctccataa

SEQ ID NO: 16162 - DNA, 1059 bp, synthetic construct
  misc_feature 1..1059: note = Synthetic polypeptide
  source 1..1059: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcagggtgagtctggagaaaacatatggaatcccagcatga

SEQ ID NO: 16163 - DNA, 1057 bp, synthetic construct
  misc_feature 1..1057: note = Synthetic polypeptide
  source 1..1057: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggatgataacaccctatgcccattgtcctgatctga

SEQ ID NO: 16164 - DNA, 1210 bp, synthetic construct
  misc_feature 1..1210: note = Synthetic polypeptide
  source 1..1210: mol_type = other DNA
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacag

SEQ ID NO: 16165 - DNA, 1807 bp, synthetic construct
  misc_feature 1..1807: note = Synthetic polypeptide
  source 1..1807: mol_type = other DNA
cagttggcccttgaacctcacgggtttgaactgcatgggtcacttatacatggatttccttccatctctgccaccccgagacaggaagaccaacccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctga

SEQ ID NO: 16166 - DNA, 220 bp, synthetic construct
  misc_feature 1..220: note = Synthetic polypeptide
  source 1..220: mol_type = other DNA
gcactccagacaaattaagtcagcttctcggaggacaaccaggcatccgtattctctaagctccccagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctag

SEQ ID NO: 16167 - DNA, 2432 bp, synthetic construct
  misc_feature 1..2432: note = Synthetic polypeptide
  source 1..2432: mol_type = other DNA
tcagtgacgtggacacagatgtggagagggaacgtatgtcttcagatgttacagagctgggagggactaattctctaggagaggatgaggatccagaaggacctgtcaggctcctggaagtaatgaaatgactgttacaggaaaaaatggcaatatatgcttacaggtcaaacagtaaattgttaagaggctaggctactgggtgactttcttgacagaagttcttgcaaaacgtcagagttgaagtggaccatagcctaacagatctcagtggagtgctttctggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccaccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtga

SEQ ID NO: 16168 - DNA, 652 bp, synthetic construct
  misc_feature 1..652: note = Synthetic polypeptide
  source 1..652: mol_type = other DNA
ggccaggcgcggtggctcacgcctgtaattccagcactttggggaggccgaggcgggcggatcacctgaggtcaggagtttgagaccaacctggccaacatgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtga

SEQ ID NO: 16169 - DNA, 917 bp, synthetic construct
  misc_feature 1..917: note = Synthetic polypeptide
  source 1..917: mol_type = other DNA
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgtttttctgttctattctattctactttcgccaatagaacacaagaaccctattgccctgcttttaccttagcctgtgctgaccttctgtggactctcataggacctctgctgcctcagaccgtatttctagcaaggtcggatccagactcagagtacccggcttggttggcttctcaggactga

SEQ ID NO: 16170 - DNA, 449 bp, synthetic construct
  misc_feature 1..449: note = Synthetic polypeptide
  source 1..449: mol_type = other DNA
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctga

SEQ ID NO: 16171 - DNA, 1040 bp, synthetic construct
  misc_feature 1..1040: note = Synthetic polypeptide
  source 1..1040: mol_type = other DNA
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaa

SEQ ID NO: 16172 - DNA, 641 bp, synthetic construct
  misc_feature 1..641: note = Synthetic polypeptide
  source 1..641: mol_type = other DNA
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgg

SEQ ID NO: 16173 - DNA, 326 bp, synthetic construct; identical to SEQ ID NO: 6850
  misc_feature 1..326: note = Synthetic polypeptide
  source 1..326: mol_type = other DNA

SEQ ID NO: 16174 - DNA, 119 bp, synthetic construct; identical to SEQ ID NO: 6851
  misc_feature 1..119: note = Synthetic polypeptide
  source 1..119: mol_type = other DNA

SEQ ID NO: 16175 - DNA, 418 bp, synthetic construct
  misc_feature 1..418: note = Synthetic polypeptide
  source 1..418: mol_type = other DNA
ggcccttcttaatccttcagatcccagctgagatattatttcctcaggacatgttttccagctctacagactagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatga

SEQ ID NO: 16176 - DNA, 343 bp, synthetic construct
  misc_feature 1..343: note = Synthetic polypeptide
  source 1..343: mol_type = other DNA
ggcccttcttaatccttcagatcccagctgagatattatttcctcaggacatgttttccagctctacagactagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccaacaacagatggctgttttggaacatttacaggcatctgtgacacaactggctcctgggaggggaagcaataa

SEQ ID NO: 16177 - DNA, 921 bp, synthetic construct; identical to SEQ ID NO: 8811
  misc_feature 1..921: note = Synthetic polypeptide
  source 1..921: mol_type = other DNA

SEQ ID NO: 16178 - DNA, 1418 bp, synthetic construct; identical to SEQ ID NO: 8571
  misc_feature 1..1418: note = Synthetic polypeptide
  source 1..1418: mol_type = other DNA

SEQ ID NO: 16179 - DNA, 1582 bp, synthetic construct; identical to SEQ ID NO: 7488
  misc_feature 1..1582: note = Synthetic polypeptide
  source 1..1582: mol_type = other DNA

SEQ ID NO: 16180 - DNA, 408 bp, synthetic construct
  misc_feature 1..408: note = Synthetic polypeptide
  source 1..408: mol_type = other DNA
gacccggtgcagtggctcatgcctgcaatcccagcactttgcgaggccaaggcatgcagactgcttgagctcaggagtttgagaccagcctggtcaacatgtatttcctgtctctacagaaaatacacacacacaaaaattagccaggcatagtggtacatgcctgtggtcccagctagtcaggaggctgacaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 16181 - DNA, 399 bp, synthetic construct
  misc_feature 1..399: note = Synthetic polypeptide
  source 1..399: mol_type = other DNA
gacccggtgcagtggctcatgcctgcaatcccagcactttgcgaggccaaggcatgcagactgcttgagctcaggagtttgagaccagcctggtcaacatgtatttcctgtctctacagaaaatacacacacacaaaaattagccaggcatagtggtacatgcctgtggtcccagctagtcaggaggctgacaatgaggaaaatggggagcaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 16182 - DNA, 783 bp, synthetic construct
  misc_feature 1..783: note = Synthetic polypeptide
  source 1..783: mol_type = other DNA
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtatcaatcacggagatcttaatgaccataatattttaatagagtccagcaagtcagcctctggaaatgctgaatatcaagtgtctgggattttagactttggtgacatgagctatggctactatgtgtttgaagtggcaattaccatcatgtacatgatgattgagagcaagagtcctatacaagtaggaggccatgtccttgcagggtttgaaagcatcaccccactgacagctgtagagaagggtgctttgtttttacttgtatgcagtcgtttttgtcagtcacttgtcatggctgcatactcttgccagctatacccagagaacaaagactatctcatggttactgcaaaaaccgggtggaaacacttacagcaaatgtttgacatgggtcagaaagctgtagaagaaatctggtttgaaactgccaaatcctatgaatctgggatctccatgtga

SEQ ID NO: 16183 - DNA, 324 bp, synthetic construct
  misc_feature 1..324: note = Synthetic polypeptide
  source 1..324: mol_type = other DNA
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatga

SEQ ID NO: 16184 - DNA, 342 bp, synthetic construct
  misc_feature 1..342: note = Synthetic polypeptide
  source 1..342: mol_type = other DNA
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtgagtattctcccaattaa

SEQ ID NO: 16185 - DNA, 373 bp, synthetic construct; identical to SEQ ID NO: 11590
  misc_feature 1..373: note = Synthetic polypeptide
  source 1..373: mol_type = other DNA

SEQ ID NO: 16186 - DNA, 226 bp, synthetic construct; identical to SEQ ID NO: 11591
  misc_feature 1..226: note = Synthetic polypeptide
  source 1..226: mol_type = other DNA

SEQ ID NO: 16187 - DNA, 232 bp, synthetic construct; identical to SEQ ID NO: 11592
  misc_feature 1..232: note = Synthetic polypeptide
  source 1..232: mol_type = other DNA

SEQ ID NO: 16188 - DNA, 367 bp, synthetic construct; identical to SEQ ID NO: 11593
  misc_feature 1..367: note = Synthetic polypeptide
  source 1..367: mol_type = other DNA

SEQ ID NO: 16189 - DNA, 543 bp, synthetic construct; identical to SEQ ID NO: 6496
  misc_feature 1..543: note = Synthetic polypeptide
  source 1..543: mol_type = other DNA

SEQ ID NO: 16190 - DNA, 378 bp, synthetic construct; identical to SEQ ID NO: 6497
  misc_feature 1..378: note = Synthetic polypeptide
  source 1..378: mol_type = other DNA

SEQ ID NO: 16191 - DNA, 267 bp, synthetic construct; identical to SEQ ID NO: 6498
  misc_feature 1..267: note = Synthetic polypeptide
  source 1..267: mol_type = other DNA

SEQ ID NO: 16192 - DNA, 416 bp, synthetic construct; identical to SEQ ID NO: 6499
  misc_feature 1..416: note = Synthetic polypeptide
  source 1..416: mol_type = other DNA

SEQ ID NO: 16193 - DNA, 162 bp, synthetic construct; identical to SEQ ID NO: 6500
  misc_feature 1..162: note = Synthetic polypeptide
  source 1..162: mol_type = other DNA

SEQ ID NO: 16194 - DNA, 1325 bp, synthetic construct; identical to SEQ ID NO: 7686
  misc_feature 1..1325: note = Synthetic polypeptide
  source 1..1325: mol_type = other DNA

SEQ ID NO: 16195 - DNA, 1691 bp, synthetic construct; identical to SEQ ID NO: 7687
  misc_feature 1..1691: note = Synthetic polypeptide
  source 1..1691: mol_type = other DNA

SEQ ID NO: 16196 - DNA, 1541 bp, synthetic construct; identical to SEQ ID NO: 7688
  misc_feature 1..1541: note = Synthetic polypeptide
  source 1..1541: mol_type = other DNA

SEQ ID NO: 16197 - DNA, 1694 bp, synthetic construct
  misc_feature 1..1694: note = Synthetic polypeptide
  source 1..1694: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 16198 - DNA, 1460 bp, synthetic construct
  misc_feature 1..1460: note = Synthetic polypeptide
  source 1..1460: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaa

SEQ ID NO: 16199 - DNA, 1091 bp, synthetic construct
  misc_feature 1..1091: note = Synthetic polypeptide
  source 1..1091: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgtctcaccagtggtattcttggggcccacctaa

SEQ ID NO: 16200 - DNA, 1457 bp, synthetic construct
  misc_feature 1..1457: note = Synthetic polypeptide
  source 1..1457: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaa

SEQ ID NO: 16201 - DNA, 1685 bp, synthetic construct
  misc_feature 1..1685: note = Synthetic polypeptide
  source 1..1685: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaaaagctcatgaagtga

SEQ ID NO: 16202 - DNA, 1697 bp, synthetic construct
  misc_feature 1..1697: note = Synthetic polypeptide
  source 1..1697: mol_type = other DNA
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 16203 - DNA, 836 bp, synthetic construct
  misc_feature 1..836: note = Synthetic polypeptide
  source 1..836: mol_type = other DNA
tacagctcctaccaggggttcttctaaggtccagctgagcattcagactcacaagatgccatgggccatgcttggtatcagattgtcttggaagcacacaggacaggaagtgcagtttgctggcagcgtggcatcgtgttagagccggtgggaggagcctccattgcagtctaggtggtggtccgtggcgctgccccagagctatcctcaggagagactcacgtgaggcaggtgcaggagctgtcctggcatagaagcttcatgttccatggagctcataacccttgtaatagctccataagcagagcttccaaagggtctaccaaagacaagcccaataacctgggaaagcccaaggatagataagccttcctaccaggtatttatcattttcttagtccagatgtgatttgtcaatcaggatttcttttttttttttcttccagaagtagtgtcacctaggaacacagtagacctaccactttgctcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattga

SEQ ID NO: 16204 - DNA, 418 bp, synthetic construct; identical to SEQ ID NO: 11223
  misc_feature 1..418: note = Synthetic polypeptide
  source 1..418: mol_type = other DNA

SEQ ID NO: 16205 - DNA, 386 bp, synthetic construct; identical to SEQ ID NO: 11224
  misc_feature 1..386: note = Synthetic polypeptide
  source 1..386: mol_type = other DNA

SEQ ID NO: 16206 - DNA, 560 bp, synthetic construct; identical to SEQ ID NO: 6322
  misc_feature 1..560: note = Synthetic polypeptide
  source 1..560: mol_type = other DNA

SEQ ID NO: 16207 - DNA, 457 bp, synthetic construct; identical to SEQ ID NO: 11225
  misc_feature 1..457: note = Synthetic polypeptide
  source 1..457: mol_type = other DNA

SEQ ID NO: 16208 - DNA, 496 bp, synthetic construct; identical to SEQ ID NO: 11226
  misc_feature 1..496: note = Synthetic polypeptide
  source 1..496: mol_type = other DNA

SEQ ID NO: 16209 - DNA, 385 bp, synthetic construct; identical to SEQ ID NO: 11229
  misc_feature 1..385: note = Synthetic polypeptide
  source 1..385: mol_type = other DNA

SEQ ID NO: 16210 - DNA, 385 bp, synthetic construct; identical to SEQ ID NO: 11229
  misc_feature 1..385: note = Synthetic polypeptide
  source 1..385: mol_type = other DNA

SEQ ID NO: 16211 - DNA, 2100 bp, synthetic construct
  misc_feature 1..2100: note = Synthetic polypeptide
  source 1..2100: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16212 - DNA, 1875 bp, synthetic construct
  misc_feature 1..1875: note = Synthetic polypeptide
  source 1..1875: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16213 - DNA, 2043 bp, synthetic construct
  misc_feature 1..2043: note = Synthetic polypeptide
  source 1..2043: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16214 - DNA, 2046 bp, synthetic construct
  misc_feature 1..2046: note = Synthetic polypeptide
  source 1..2046: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16215 - DNA, 1932 bp, synthetic construct
  misc_feature 1..1932: note = Synthetic polypeptide
  source 1..1932: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16216 - DNA, 1479 bp, synthetic construct
  misc_feature 1..1479: note = Synthetic polypeptide
  source 1..1479: mol_type = other DNA
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttga

SEQ ID NO: 16217 - DNA, 385 bp, synthetic construct; identical to SEQ ID NO: 11229
  misc_feature 1..385: note = Synthetic polypeptide
  source 1..385: mol_type = other DNA

SEQ ID NO: 16218 - DNA, 2243 bp, synthetic construct; identical to SEQ ID NO: 8048
  misc_feature 1..2243: note = Synthetic polypeptide
  source 1..2243: mol_type = other DNA

SEQ ID NO: 16219 - DNA, 1338 bp, synthetic construct; identical to SEQ ID NO: 8049
  misc_feature 1..1338: note = Synthetic polypeptide
  source 1..1338: mol_type = other DNA

SEQ ID NO: 16220 - DNA, 1263 bp, synthetic construct; identical to SEQ ID NO: 8050
  misc_feature 1..1263: note = Synthetic polypeptide
  source 1..1263: mol_type = other DNA

SEQ ID NO: 16221 - DNA, 418 bp, synthetic construct; identical to SEQ ID NO: 11223
  misc_feature 1..418: note = Synthetic polypeptide
  source 1..418: mol_type = other DNA

SEQ ID NO: 16222 - DNA, 418 bp, synthetic construct; identical to SEQ ID NO: 11223
  misc_feature 1..418: note = Synthetic polypeptide
  source 1..418: mol_type = other DNA

SEQ ID NO: 16223 - DNA, 418 bp, synthetic construct; identical to SEQ ID NO: 11223
  misc_feature 1..418: note = Synthetic polypeptide
  source 1..418: mol_type = other DNA

SEQ ID NO: 16224 - DNA, 418 bp, synthetic construct; identical to SEQ ID NO: 11223
  misc_feature 1..418: note = Synthetic polypeptide
  source 1..418: mol_type = other DNA

SEQ ID NO: 16225 - DNA, 418 bp, synthetic construct; identical to SEQ ID NO: 11223
  misc_feature 1..418: note = Synthetic polypeptide
  source 1..418: mol_type = other DNA

SEQ ID NO: 16226 - DNA, 1391 bp, synthetic construct
  misc_feature 1..1391: note = Synthetic polypeptide
  source 1..1391: mol_type = other DNA
ggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16227 - DNA, 1061 bp, synthetic construct
  misc_feature 1..1061: note = Synthetic polypeptide
  source 1..1061: mol_type = other DNA
ggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16228 - DNA, 938 bp, synthetic construct
  misc_feature 1..938: note = Synthetic polypeptide
  source 1..938: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16229 - DNA, 1727 bp, synthetic construct
  misc_feature 1..1727: note = Synthetic polypeptide
  source 1..1727: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16230 - DNA, 133 bp, synthetic construct; identical to SEQ ID NO: 6551
  misc_feature 1..133: note = Synthetic polypeptide
  source 1..133: mol_type = other DNA

SEQ ID NO: 16231 - DNA, 2665 bp, synthetic construct; identical to SEQ ID NO: 7249
  misc_feature 1..2665: note = Synthetic polypeptide
  source 1..2665: mol_type = other DNA

SEQ ID NO: 16232 - DNA, 1376 bp, synthetic construct; identical to SEQ ID NO: 9418
  misc_feature 1..1376: note = Synthetic polypeptide
  source 1..1376: mol_type = other DNA

SEQ ID NO: 16233 - DNA, 1211 bp, synthetic construct; identical to SEQ ID NO: 9419
  misc_feature 1..1211: note = Synthetic polypeptide
  source 1..1211: mol_type = other DNA

SEQ ID NO: 16234 - DNA, 1100 bp, synthetic construct; identical to SEQ ID NO: 9420
  misc_feature 1..1100: note = Synthetic polypeptide
  source 1..1100: mol_type = other DNA

SEQ ID NO: 16235 - DNA, 1249 bp, synthetic construct; identical to SEQ ID NO: 9421
  misc_feature 1..1249: note = Synthetic polypeptide
  source 1..1249: mol_type = other DNA

SEQ ID NO: 16236 - DNA, 2284 bp, synthetic construct
  misc_feature 1..2284: note = Synthetic polypeptide
  source 1..2284: mol_type = other DNA
aaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 16237 - DNA, 2440 bp, synthetic construct
  misc_feature 1..2440: note = Synthetic polypeptide
  source 1..2440: mol_type = other DNA
aaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 16238 - DNA, 1239 bp, synthetic construct; identical to SEQ ID NO: 9334
  misc_feature 1..1239: note = Synthetic polypeptide
  source 1..1239: mol_type = other DNA

SEQ ID NO: 16239 - DNA, 5350 bp, synthetic construct; identical to SEQ ID NO: 655
  misc_feature 1..5350: note = Synthetic polypeptide
  source 1..5350: mol_type = other DNA

SEQ ID NO: 16240 - DNA, 1325 bp, synthetic construct; identical to SEQ ID NO: 13366
  misc_feature 1..1325: note = Synthetic polypeptide
  source 1..1325: mol_type = other DNA

SEQ ID NO: 16241 - DNA, 776 bp, synthetic construct; identical to SEQ ID NO: 13367
  misc_feature 1..776: note = Synthetic polypeptide
  source 1..776: mol_type = other DNA

SEQ ID NO: 16242 - DNA, 467 bp, synthetic construct; identical to SEQ ID NO: 13368
  misc_feature 1..467: note = Synthetic polypeptide
  source 1..467: mol_type = other DNA

SEQ ID NO: 16243 - DNA, 1521 bp, synthetic construct
  misc_feature 1..1521: note = Synthetic polypeptide
  source 1..1521: mol_type = other DNA
tagaatgagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtga

SEQ ID NO: 16244 - DNA, 1323 bp, synthetic construct; identical to SEQ ID NO: 13303
  misc_feature 1..1323: note = Synthetic polypeptide
  source 1..1323: mol_type = other DNA

SEQ ID NO: 16245 - DNA, 1470 bp, synthetic construct; identical to SEQ ID NO: 13304
  misc_feature 1..1470: note = Synthetic polypeptide
  source 1..1470: mol_type = other DNA

SEQ ID NO: 16246 - DNA, 691 bp, synthetic construct; identical to SEQ ID NO: 13305
  misc_feature 1..691: note = Synthetic polypeptide
  source 1..691: mol_type = other DNA

SEQ ID NO: 16247 - DNA, 728 bp, synthetic construct
  misc_feature 1..728: note = Synthetic polypeptide
  source 1..728: mol_type = other DNA
aggagacagttggaaaagggctcacagagaagacagccatgagaagactgaagtgggtagagattgaagtcatgctgccacaagccaaagaacatctgaggatgccagaagctgaaaggggcgaggaagagacaagggagtctccccaagagccttcagagggagcatgccgttgctgatacatagatgttggtcttctagcctacggaattgaccctgtggatttagacatataccaaagctcccacatggtcgactatcagccctacaggaagcacaaatactccagggtcacgccgcaagagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtag

SEQ ID NO: 16248 - DNA, 919 bp, synthetic construct
  misc_feature 1..919: note = Synthetic polypeptide
  source 1..919: mol_type = other DNA
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 16249 - DNA, 978 bp, synthetic construct
  misc_feature 1..978: note = Synthetic polypeptide
  source 1..978: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16250 - DNA, 1767 bp, synthetic construct
  misc_feature 1..1767: note = Synthetic polypeptide
  source 1..1767: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16251 - DNA, 228 bp, synthetic construct
  misc_feature 1..228: note = Synthetic polypeptide
  source 1..228: mol_type = other DNA
tgggggccccagtgagatattaatgccaccgggcaagagccggtcttgctccaggctcccccggaaggacggctggctcggagggggagcgccacctaagaattttcaggtccccgaagagtgaccgtcttccggaggagagcggattgactacggtgtgggtgccctaaaattcaacatctgagtcctcagcttctgaccccagggtcagttattgactctggatga

SEQ ID NO: 16252 - DNA, 735 bp, synthetic construct
  misc_feature 1..735: note = Synthetic polypeptide
  source 1..735: mol_type = other DNA
caggagtccccagaccccaggcagcggaccagcactggtccgtggcctgttaggaaccaggccacatagcaggaggtaaggggcaggtgagcgatcattgccgcctgagctccgcctcctatcagaccagcggcagcattagattttcataggagtacaaaccctatcgtgaactgcgcatgcaggggatctaggttgcatgttccttatgagaatctaactaatgcctgttgatctgagggggaacagtttcatctagaaaccagcagccctccgccatccgtggaaaaattgtcttccacgaaactggtctctggtgccaaaaaggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaa

SEQ ID NO: 16253 - DNA, 551 bp, synthetic construct
  misc_feature 1..551: note = Synthetic polypeptide
  source 1..551: mol_type = other DNA
ggccaggtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaa

SEQ ID NO: 16254 - DNA, 835 bp, synthetic construct; identical to SEQ ID NO: 6764
  misc_feature 1..835: note = Synthetic polypeptide
  source 1..835: mol_type = other DNA

SEQ ID NO: 16255 - DNA, 624 bp, synthetic construct; identical to SEQ ID NO: 9709
  misc_feature 1..624: note = Synthetic polypeptide
  source 1..624: mol_type = other DNA

SEQ ID NO: 16256 - DNA, 441 bp, synthetic construct
  misc_feature 1..441: note = Synthetic polypeptide
  source 1..441: mol_type = other DNA
gcgcggtgactcacacctgtaatcccagcactttgggaggccaaggcaggcggatcacgaggtcagaagatcgagaccatcctagctaacaagcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaa

SEQ ID NO: 16257 - DNA, 917 bp, synthetic construct
  misc_feature 1..917: note = Synthetic polypeptide
  source 1..917: mol_type = other DNA
ctctccctctccctctccctctccctctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcacgcgccgccacgcctgattggttttggtggagacggggtttcgctgtgttggccgggccggtctccagcccctaaccgcgagtgatccgccaacctcggcctcccgaggtgccgggattgcagatggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcccggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaatcctcctgcatatgcccaagaggattgggagtggaatggacaccagcagaagcaccacagttattcctgtag

SEQ ID NO: 16258 - DNA, 1014 bp, synthetic construct
  misc_feature 1..1014: note = Synthetic polypeptide
  source 1..1014: mol_type = other DNA
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaagtgaggagcccctctgcccggcagccaccccgtctgggaaggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 16259 - DNA, 239 bp, synthetic construct
  misc_feature 1..239: note = Synthetic polypeptide
  source 1..239: mol_type = other DNA
aggaagaactagaactgaatttatttacaggcagtatgatcttgtatgtagaagacctggaagaatctacaaagaagctaccagaataagtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 16260 - DNA, 1656 bp, synthetic construct
  misc_feature 1..1656: note = Synthetic polypeptide
  source 1..1656: mol_type = other DNA
ggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 16261 - DNA, 1512 bp, synthetic construct
  misc_feature 1..1512: note = Synthetic polypeptide
  source 1..1512: mol_type = other DNA
ggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 16262 - DNA, 2314 bp, synthetic construct
  misc_feature 1..2314: note = Synthetic polypeptide
  source 1..2314: mol_type = other DNA
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaa

SEQ ID NO: 16263 - DNA, 2290 bp, synthetic construct
  misc_feature 1..2290: note = Synthetic polypeptide
  source 1..2290: mol_type = other DNA
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaa

SEQ ID NO: 16264 - DNA, 1018 bp, synthetic construct
  misc_feature 1..1018: note = Synthetic polypeptide
  source 1..1018: mol_type = other DNA
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggacaaagcccagccattccacctcccttaccgacagaacaagcttccagacccactccggcatcacctgcccttgaaggcaagtacttttttttttcttaa

SEQ ID NO: 16265 - DNA, 628 bp, synthetic construct
  misc_feature 1..628: note = Synthetic polypeptide
  source 1..628: mol_type = other DNA
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagaagttggacacagctcttga

SEQ ID NO: 16266 - DNA, 2792 bp, synthetic construct
  misc_feature 1..2792: note = Synthetic polypeptide
  source 1..2792: mol_type = other DNA
ccctgcccctgcccctgcccctgcccctgcctctgcctctgcctctgcctcgtctccctctgatgccgagccaaacctggactgtactgctgccatctcggctcactgcaacctccctgcctgattctcctgcctcagcctgccgagtgcctgcgattgcaggcgcacgccgccacgcctgactggttttcgttttttttttggtggagacggggttttgctctgttggccgggctggtctccagctcctaaccgcgagtgatccgccagcctcggcctcccgaggtgccgggattgcagacggagttcgttcactcagtgctcaatggtgcccaggctggagtgcagtggcgtgatctcggctcgctacaacctccacctcccagccgcctgccttggcctcccaaagtgccgagattgcagcctttgcccagccgccaccccgtctgggaagtgaggagcgtctctgcctggccccccatcgtctgggatatgaggagcctctctgcctggctgcacagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 16267 - DNA, 2590 bp, synthetic construct
  misc_feature 1..2590: note = Synthetic polypeptide
  source 1..2590: mol_type = other DNA
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataa

SEQ ID NO: 16268 - DNA, 1924 bp, synthetic construct
  misc_feature 1..1924: note = Synthetic polypeptide
  source 1..1924: mol_type = other DNA
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttga

SEQ ID NO: 16269 - DNA, 2530 bp, synthetic construct
  misc_feature 1..2530: note = Synthetic polypeptide
  source 1..2530: mol_type = other DNA
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattag

SEQ ID NO: 16270 - DNA, 1397 bp, synthetic construct; identical to SEQ ID NO: 14804
  misc_feature 1..1397: note = Synthetic polypeptide
  source 1..1397: mol_type = other DNA

SEQ ID NO: 16271 - DNA, 1331 bp, synthetic construct; identical to SEQ ID NO: 14805
  misc_feature 1..1331: note = Synthetic polypeptide
  source 1..1331: mol_type = other DNA

SEQ ID NO: 16272 - DNA, 167 bp, synthetic construct; identical to SEQ ID NO: 10038
  misc_feature 1..167: note = Synthetic polypeptide
  source 1..167: mol_type = other DNA

SEQ ID NO: 16273 - DNA, 334 bp, synthetic construct
  misc_feature 1..334: note = Synthetic polypeptide
  source 1..334: mol_type = other DNA
ccagcccgtgccagatcgacagaatctagaagttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataa

SEQ ID NO: 16274 - DNA, 1737 bp, synthetic construct; identical to SEQ ID NO: 905
  misc_feature 1..1737: note = Synthetic polypeptide
  source 1..1737: mol_type = other DNA

SEQ ID NO: 16275 - DNA, 284 bp, synthetic construct; identical to SEQ ID NO: 906
  misc_feature 1..284: note = Synthetic polypeptide
  source 1..284: mol_type = other DNA

SEQ ID NO: 16276 - DNA, 856 bp, synthetic construct; identical to SEQ ID NO: 907
  misc_feature 1..856: note = Synthetic polypeptide
  source 1..856: mol_type = other DNA

SEQ ID NO: 16277 - DNA, 802 bp, synthetic construct; identical to SEQ ID NO: 908
  misc_feature 1..802: note = Synthetic polypeptide
  source 1..802: mol_type = other DNA

SEQ ID NO: 16278 - DNA, 561 bp, synthetic construct; identical to SEQ ID NO: 909
  misc_feature 1..561: note = Synthetic polypeptide
  source 1..561: mol_type = other DNA

SEQ ID NO: 16279 - DNA, 582 bp, synthetic construct; identical to SEQ ID NO: 910
  misc_feature 1..582: note = Synthetic polypeptide
  source 1..582: mol_type = other DNA

SEQ ID NO: 16280 - DNA, 1189 bp, synthetic construct
  misc_feature 1..1189: note = Synthetic polypeptide
  source 1..1189: mol_type = other DNA
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtag

SEQ ID NO: 16281 - DNA, 958 bp, synthetic construct
  misc_feature 1..958: note = Synthetic polypeptide
  source 1..958: mol_type = other DNA
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatatgaggtgttgctgtgttgcccagactggtctcaaactcctggcctcaagtcatcctcctgccttggcatcccaaaatgctggaattag

SEQ ID NO: 16282 - DNA, 943 bp, synthetic construct
  misc_feature 1..943: note = Synthetic polypeptide
  source 1..943: mol_type = other DNA
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaa

SEQ ID NO: 16283 - DNA, 3243 bp, synthetic construct; identical to SEQ ID NO: 12893
  misc_feature 1..3243: note = Synthetic polypeptide
  source 1..3243: mol_type = other DNA

SEQ ID NO: 16284 - DNA, 878 bp, synthetic construct; identical to SEQ ID NO: 12894
  misc_feature 1..878: note = Synthetic polypeptide
  source 1..878: mol_type = other DNA

SEQ ID NO: 16285 - DNA, 545 bp, synthetic construct; identical to SEQ ID NO: 12895
  misc_feature 1..545: note = Synthetic polypeptide
  source 1..545: mol_type = other DNA

SEQ ID NO: 16286 - DNA, 877 bp, synthetic construct; identical to SEQ ID NO: 12896
  misc_feature 1..877: note = Synthetic polypeptide
  source 1..877: mol_type = other DNA

SEQ ID NO: 16287 - DNA, 498 bp, synthetic construct; identical to SEQ ID NO: 12897
  misc_feature 1..498: note = Synthetic polypeptide
  source 1..498: mol_type = other DNA

SEQ ID NO: 16288 - DNA, 615 bp, synthetic construct; identical to SEQ ID NO: 12898
  misc_feature 1..615: note = Synthetic polypeptide
  source 1..615: mol_type = other DNA

SEQ ID NO: 16289 - DNA, 427 bp, synthetic construct; identical to SEQ ID NO: 573
  misc_feature 1..427: note = Synthetic polypeptide
  source 1..427: mol_type = other DNA

SEQ ID NO: 16290 - DNA, 1662 bp, synthetic construct
  misc_feature 1..1662: note = Synthetic polypeptide
  source 1..1662: mol_type = other DNA
gcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaa

SEQ ID NO: 16291 - DNA, 357 bp, synthetic construct; identical to SEQ ID NO: 10751
  misc_feature 1..357: note = Synthetic polypeptide
  source 1..357: mol_type = other DNA

SEQ ID NO: 16292 - DNA, 956 bp, synthetic construct; identical to SEQ ID NO: 7135
  misc_feature 1..956: note = Synthetic polypeptide
  source 1..956: mol_type = other DNA

SEQ ID NO: 16293 - DNA, 2681 bp, synthetic construct
  misc_feature 1..2681: note = Synthetic polypeptide
  source 1..2681: mol_type = other DNA
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccatag

SEQ ID NO: 16294 - DNA, 2684 bp, synthetic construct
  misc_feature 1..2684: note = Synthetic polypeptide
  source 1..2684: mol_type = other DNA
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccatag

SEQ ID NO: 16295 - DNA, 875 bp, synthetic construct
  misc_feature 1..875: note = Synthetic polypeptide
  source 1..875: mol_type = other DNA
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggaggatgttaa

SEQ ID NO: 16296 - DNA, 470 bp, synthetic construct; identical to SEQ ID NO: 9114
  misc_feature 1..470: note = Synthetic polypeptide
  source 1..470: mol_type = other DNA

SEQ ID NO: 16297 - DNA, 134 bp, synthetic construct; identical to SEQ ID NO: 9115
  misc_feature 1..134: note = Synthetic polypeptide
  source 1..134: mol_type = other DNA

SEQ ID NO: 16298 - DNA, 36 bp, synthetic construct; identical to SEQ ID NO: 12516
  misc_feature 1..36: note = Synthetic polypeptide
  source 1..36: mol_type = other DNA

SEQ ID NO: 16299 - DNA, 217 bp, synthetic construct; identical to SEQ ID NO: 12517
  misc_feature 1..217: note = Synthetic polypeptide
  source 1..217: mol_type = other DNA

SEQ ID NO: 16300 - DNA, 52 bp, synthetic construct; identical to SEQ ID NO: 12518
  misc_feature 1..52: note = Synthetic polypeptide
  source 1..52: mol_type = other DNA

SEQ ID NO: 16301 - DNA, 172 bp, synthetic construct; identical to SEQ ID NO: 12519
  misc_feature 1..172: note = Synthetic polypeptide
  source 1..172: mol_type = other DNA

SEQ ID NO: 16302 - DNA, 154 bp, synthetic construct; identical to SEQ ID NO: 12520
  misc_feature 1..154: note = Synthetic polypeptide
  source 1..154: mol_type = other DNA

SEQ ID NO: 16303 - DNA, 20 bp, synthetic construct
  misc_feature 1..20: note = Synthetic polypeptide
  source 1..20: mol_type = other DNA
ttaacatccttgtttattga

SEQ ID NO: 16304 - DNA, 174 bp, synthetic construct; identical to SEQ ID NO: 12522
  misc_feature 1..174: note = Synthetic polypeptide
  source 1..174: mol_type = other DNA

SEQ ID NO: 16305 - DNA, 148 bp, synthetic construct; identical to SEQ ID NO: 12523
  misc_feature 1..148: note = Synthetic polypeptide
  source 1..148: mol_type = other DNA

SEQ ID NO: 16306 - DNA, 575 bp, synthetic construct
  misc_feature 1..575: note = Synthetic polypeptide
  source 1..575: mol_type = other DNA
cccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaa

SEQ ID NO: 16307 - DNA, 446 bp, synthetic construct
  misc_feature 1..446: note = Synthetic polypeptide
  source 1..446: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagagtttaaagattttcaacgacgaattcttgtggctaccaacctatttggccgaggcatggacatcgagcgggtga

SEQ ID NO: 16308 - DNA, 674 bp, synthetic construct
  misc_feature 1..674: note = Synthetic polypeptide
  source 1..674: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatag

SEQ ID NO: 16309 - DNA, 683 bp, synthetic construct
  misc_feature 1..683: note = Synthetic polypeptide
  source 1..683: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtag

SEQ ID NO: 16310 - DNA, 666 bp, synthetic construct
  misc_feature 1..666: note = Synthetic polypeptide
  source 1..666: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctaca

SEQ ID NO: 16311 - DNA, 367 bp, synthetic construct
  misc_feature 1..367: note = Synthetic polypeptide
  source 1..367: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 16312 - DNA, 263 bp, synthetic construct
  misc_feature 1..263: note = Synthetic polypeptide
  source 1..263: mol_type = other DNA
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 16313 - DNA, 1234 bp, synthetic construct; identical to SEQ ID NO: 13601
  misc_feature 1..1234: note = Synthetic polypeptide
  source 1..1234: mol_type = other DNA

SEQ ID NO: 16314 - DNA, 961 bp, synthetic construct; identical to SEQ ID NO: 6722
  misc_feature 1..961: note = Synthetic polypeptide
  source 1..961: mol_type = other DNA

SEQ ID NO: 16315 - DNA, 1445 bp, synthetic construct; identical to SEQ ID NO: 15858
  misc_feature 1..1445: note = Synthetic polypeptide
  source 1..1445: mol_type = other DNA

SEQ ID NO: 16316 - DNA, 1472 bp, synthetic construct; identical to SEQ ID NO: 15859
  misc_feature 1..1472: note = Synthetic polypeptide
  source 1..1472: mol_type = other DNA

SEQ ID NO: 16317 - DNA, 797 bp, synthetic construct; identical to SEQ ID NO: 15860
  misc_feature 1..797: note = Synthetic polypeptide
  source 1..797: mol_type = other DNA

SEQ ID NO: 16318 - DNA, 1174 bp, synthetic construct
  misc_feature 1..1174: note = Synthetic polypeptide
  source 1..1174: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 16319 - DNA, 1009 bp, synthetic construct
  misc_feature 1..1009: note = Synthetic polypeptide
  source 1..1009: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 16320 - DNA, 898 bp, synthetic construct
  misc_feature 1..898: note = Synthetic polypeptide
  source 1..898: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 16321 - DNA, 1047 bp, synthetic construct
  misc_feature 1..1047: note = Synthetic polypeptide
  source 1..1047: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 16322 - DNA, 1969 bp, synthetic construct
  misc_feature 1..1969: note = Synthetic polypeptide
  source 1..1969: mol_type = other DNA
ccccagacctctcacccaggaccccaagtgtgcacctttgaagccattgtcttcactcctgactgatagatcggggatccaatggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatga

SEQ ID NO: 16323 - DNA, 1530 bp, synthetic construct; identical to SEQ ID NO: 7238
  misc_feature 1..1530: note = Synthetic polypeptide
  source 1..1530: mol_type = other DNA

SEQ ID NO: 16324 - DNA, 369 bp, synthetic construct; identical to SEQ ID NO: 7239
  misc_feature 1..369: note = Synthetic polypeptide
  source 1..369: mol_type = other DNA

SEQ ID NO: 16325 - DNA, 342 bp, synthetic construct; identical to SEQ ID NO: 7240
  misc_feature 1..342: note = Synthetic polypeptide
  source 1..342: mol_type = other DNA

SEQ ID NO: 16326 - DNA, 1419 bp, synthetic construct; identical to SEQ ID NO: 7241
  misc_feature 1..1419: note = Synthetic polypeptide
  source 1..1419: mol_type = other DNA

SEQ ID NO: 16327 - DNA, 190 bp, synthetic construct
  misc_feature 1..190: note = Synthetic polypeptide
  source 1..190: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccagaggaactagaacgggacaagagggtcacttggattgtggagttctttgccaattggtctaa

SEQ ID NO: 16328 - DNA, 655 bp, synthetic construct
  misc_feature 1..655: note = Synthetic polypeptide
  source 1..655: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccatgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataa

SEQ ID NO: 16329 - DNA, 190 bp, synthetic construct
  misc_feature 1..190: note = Synthetic polypeptide
  source 1..190: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccactctctccttcctgcttcctccttgctgtggtggctgggatgcttcttccatgattttttga

SEQ ID NO: 16330 - DNA, 139 bp, synthetic construct
  misc_feature 1..139: note = Synthetic polypeptide
  source 1..139: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccagtacaaagtga

SEQ ID NO: 16331 - DNA, 769 bp, synthetic construct
  misc_feature 1..769: note = Synthetic polypeptide
  source 1..769: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataa

SEQ ID NO: 16332 - DNA, 226 bp, synthetic construct
  misc_feature 1..226: note = Synthetic polypeptide
  source 1..226: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatatag

SEQ ID NO: 16333 - DNA, 133 bp, synthetic construct
  misc_feature 1..133: note = Synthetic polypeptide
  source 1..133: mol_type = other DNA
taatatggctcccaacgttggcctcagagaagactcagaaccccaaaggagttgcccgagactggagagagaagtggagatcctgatgtttctcagtgccattgtgatgatgaagaaccgcagatccagctga

SEQ ID NO: 16334 - DNA, 896 bp, synthetic construct
  misc_feature 1..896: note = Synthetic polypeptide
  source 1..896: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16335 - DNA, 962 bp, synthetic construct
  misc_feature 1..962: note = Synthetic polypeptide
  source 1..962: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16336 - DNA, 1031 bp, synthetic construct
  misc_feature 1..1031: note = Synthetic polypeptide
  source 1..1031: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16337 - DNA, 890 bp, synthetic construct
  misc_feature 1..890: note = Synthetic polypeptide
  source 1..890: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16338 - DNA, 277 bp, synthetic construct
  misc_feature 1..277: note = Synthetic polypeptide
  source 1..277: mol_type = other DNA
attgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggcaaaagtcaacaactctagcttaattggagtaggctatactcagactctgaggcctggtgtgaagcttacactctctgctctggtagatgggaagagcattaatgctggag

SEQ ID NO: 16339 - DNA, 315 bp, synthetic construct
  misc_feature 1..315: note = Synthetic polypeptide
  source 1..315: mol_type = other DNA
attgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaa

SEQ ID NO: 16340 - DNA, 1082 bp, synthetic construct
  misc_feature 1..1082: note = Synthetic polypeptide
  source 1..1082: mol_type = other DNA
ttcccccagccctctactcattcttcaggttggagcttaggattgtctccttcaggttgcctttcctgactgtgctactgcgttcccctcccccactagagcacacatcaccctgtgtggcaattccctgtttacatgtcttgttttccccactagaccataagccacaagggggagggactcttgtcttatccgtcgtcattattcctgctgcttattgaaggtgttgcctgccacagagaagacctcactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 16341 - DNA, 819 bp, synthetic construct; identical to SEQ ID NO: 13668
  misc_feature 1..819: note = Synthetic polypeptide
  source 1..819: mol_type = other DNA

SEQ ID NO: 16342 - DNA, 885 bp, synthetic construct; identical to SEQ ID NO: 13669
  misc_feature 1..885: note = Synthetic polypeptide
  source 1..885: mol_type = other DNA

SEQ ID NO: 16343 - DNA, 954 bp, synthetic construct; identical to SEQ ID NO: 13670
  misc_feature 1..954: note = Synthetic polypeptide
  source 1..954: mol_type = other DNA

SEQ ID NO: 16344 - DNA, 813 bp, synthetic construct; identical to SEQ ID NO: 13671
  misc_feature 1..813: note = Synthetic polypeptide
  source 1..813: mol_type = other DNA

SEQ ID NO: 16345 - DNA, 1131 bp, synthetic construct
  misc_feature 1..1131: note = Synthetic polypeptide
  source 1..1131: mol_type = other DNA
cagtgattctcaaactcaagagcctcgggttctggcaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 16346 - DNA, 574 bp, synthetic construct
  misc_feature 1..574: note = Synthetic polypeptide
  source 1..574: mol_type = other DNA
cagcactttgggaggctgagatgggtggatcatttgaggtcaggagttcgagaccagcttggccaacgtggtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatga

SEQ ID NO: 16347 - DNA, 1058 bp, synthetic construct; identical to SEQ ID NO: 13964
  misc_feature 1..1058: note = Synthetic polypeptide
  source 1..1058: mol_type = other DNA

SEQ ID NO: 16348 - DNA, 970 bp, synthetic construct; identical to SEQ ID NO: 711
  misc_feature 1..970: note = Synthetic polypeptide
  source 1..970: mol_type = other DNA

SEQ ID NO: 16349 - DNA, 658 bp, synthetic construct
  misc_feature 1..658: note = Synthetic polypeptide
  source 1..658: mol_type = other DNA
ggccaggcacggtggctcatgcctgtaatcctagcacttcgggaggctgaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctga

SEQ ID NO: 16350 - DNA, 1791 bp, synthetic construct
  misc_feature 1..1791: note = Synthetic polypeptide
  source 1..1791: mol_type = other DNA
aaaaacctctctcgttccttctcctcctccagctcctgcctcatttctctcattccctttaaggtaaaacacctcagaaaagctgtcgatgctggctatctccagttctggtcctctcatcctctcttgaaccactctgtttaggattttgaccccttgccttaacaaaaccattctcttaggacactcaatgaccttcccagtattaaaccccatgcttgactttcagttctcaacttccttgacttttcagcagcatttaggacacttgacttttcctgcctcctgcagaggctttcttcacctgcttgcagatgcaccctctctaggttctccctgctccttctcagtgtcctttgttagttcctcctcatttcccaggctccacccttggcctccaccttttttcctacttcctggtgccctcatccactcttgtgtctgaatgtcctctatatgctgatctcttgcctggactctcccctggaatccagactcctatatacaaccgcctgctctacatctccactgaaatatctcatgggtgcctgaaacttaaatatatccaaaactaaattcctaaactcagcagtatccccaaaagctgctgctttcccttttcagttaatggcgattccatcctgtagctgctgttcaggccaaaaaacatgactcatcctcaaacatccctcctataccttacttcctatccctcagcagatgctttaaaatatagccaggatccaagcactgctgcaaactcctcgactcccaccctgggcccaagccagtcatcagctcttgcctggatgataacaacagccggttactgctcccctgcttctgcggcttgcctcctccatctgttttcaacacagcaatcagagtgctgaaaacgtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtga

SEQ ID NO: 16351 - DNA, 1513 bp, synthetic construct
  misc_feature 1..1513: note = Synthetic polypeptide
  source 1..1513: mol_type = other DNA
atttctggagaatgaggccacagatgggcattttttaaaagccttctcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttga

SEQ ID NO: 16352 - DNA, 206 bp, synthetic construct; identical to SEQ ID NO: 10737
  misc_feature 1..206: note = Synthetic polypeptide
  source 1..206: mol_type = other DNA

SEQ ID NO: 16353 - DNA, 1038 bp, synthetic construct; identical to SEQ ID NO: 12062
  misc_feature 1..1038: note = Synthetic polypeptide
  source 1..1038: mol_type = other DNA

SEQ ID NO: 16354 - DNA, 410 bp, synthetic construct
  misc_feature 1..410: note = Synthetic polypeptide
  source 1..410: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagc

SEQ ID NO: 16355 - DNA, 2910 bp, synthetic construct
  misc_feature 1..2910: note = Synthetic polypeptide
  source 1..2910: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaa

SEQ ID NO: 16356 - DNA, 2886 bp, synthetic construct
  misc_feature 1..2886: note = Synthetic polypeptide
  source 1..2886: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacgggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaa

SEQ ID NO: 16357 - DNA, 433 bp, synthetic construct
  misc_feature 1..433: note = Synthetic polypeptide
  source 1..433: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggctgggaaacctattgcaggtaaaccgaaccctgggtcggaatgtgcctctagcctcccaactcatcctgatgcctaatgggg

SEQ ID NO: 16358 - DNA, 443 bp, synthetic construct
  misc_feature 1..443: note = Synthetic polypeptide
  source 1..443: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctc

SEQ ID NO: 16359 - DNA, 450 bp, synthetic construct
  misc_feature 1..450: note = Synthetic polypeptide
  source 1..450: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcagtccagcaggaggtgccatctgctcagtctcctggagttcatgcagatgcagatcaggttcagaacttggcagtaa

SEQ ID NO: 16360 - DNA, 318 bp, synthetic construct
  misc_feature 1..318: note = Synthetic polypeptide
  source 1..318: mol_type = other DNA
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccaccc

SEQ ID NO: 16361 - DNA, 456 bp, synthetic construct; identical to SEQ ID NO: 6649
  misc_feature 1..456: note = Synthetic polypeptide
  source 1..456: mol_type = other DNA

SEQ ID NO: 16362 - DNA, 480 bp, synthetic construct; identical to SEQ ID NO: 6650
  misc_feature 1..480: note = Synthetic polypeptide
  source 1..480: mol_type = other DNA

SEQ ID NO: 16363 - DNA, 186 bp, synthetic construct; identical to SEQ ID NO: 6651
  misc_feature 1..186: note = Synthetic polypeptide
  source 1..186: mol_type = other DNA

SEQ ID NO: 16364 - DNA, 1275 bp, synthetic construct
  misc_feature 1..1275: note = Synthetic polypeptide
  source 1..1275: mol_type = other DNA
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaccaagtatcaggggatctgtcctcctgttacccgaaacgaaacccactttgatgctggagctaagtttcatgttccaaatgtga

SEQ ID NO: 16365 - DNA, 3768 bp, synthetic construct
  misc_feature 1..3768: note = Synthetic polypeptide
  source 1..3768: mol_type = other DNA
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctga

SEQ ID NO: 16366 - DNA, 3285 bp, synthetic construct
  misc_feature 1..3285: note = Synthetic polypeptide
  source 1..3285: mol_type = other DNA
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccaccccttctcccagcacacggctgcctga

SEQ ID NO: 16367 - DNA, 789 bp, synthetic construct
  misc_feature 1..789: note = Synthetic polypeptide
  source 1..789: mol_type = other DNA
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcag

SEQ ID NO: 16368 - DNA, 731 bp, synthetic construct
  misc_feature 1..731: note = Synthetic polypeptide
  source 1..731: mol_type = other DNA
tgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16369 - DNA, 764 bp, synthetic construct
  misc_feature 1..764: note = Synthetic polypeptide
  source 1..764: mol_type = other DNA
gtgcctgcagaaggggtcctacagtctggtgggtctaagagcttgggttgggcttaagtcccagcccagccactcactggcatggagaggacggaaggtgtttggctagtcacctgacctcactgagcctcagcttcctcatctgagagagagaacctaatgagcaaggcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatag

SEQ ID NO: 16370 - DNA, 1142 bp, synthetic construct
  misc_feature 1..1142: note = Synthetic polypeptide
  source 1..1142: mol_type = other DNA
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16371 - DNA, 1100 bp, synthetic construct
  misc_feature 1..1100: note = Synthetic polypeptide
  source 1..1100: mol_type = other DNA
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16372 - DNA, 1196 bp, synthetic construct
  misc_feature 1..1196: note = Synthetic polypeptide
  source 1..1196: mol_type = other DNA
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16373 - DNA, 1334 bp, synthetic construct; identical to SEQ ID NO: 9457
  misc_feature 1..1334: note = Synthetic polypeptide
  source 1..1334: mol_type = other DNA

SEQ ID NO: 16374 - DNA, 701 bp, synthetic construct; identical to SEQ ID NO: 9458
  misc_feature 1..701: note = Synthetic polypeptide
  source 1..701: mol_type = other DNA

SEQ ID NO: 16375 - DNA, 2870 bp, synthetic construct; identical to SEQ ID NO: 9459
  misc_feature 1..2870: note = Synthetic polypeptide
  source 1..2870: mol_type = other DNA

SEQ ID NO: 16376 - DNA, 2053 bp, synthetic construct; identical to SEQ ID NO: 7369
  misc_feature 1..2053: note = Synthetic polypeptide
  source 1..2053: mol_type = other DNA

SEQ ID NO: 16377 - DNA, 632 bp, synthetic construct
  misc_feature 1..632: note = Synthetic polypeptide
  source 1..632: mol_type = other DNA
agaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcagggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctga

SEQ ID NO: 16378 - DNA, 2281 bp, synthetic construct; identical to SEQ ID NO: 15803
  misc_feature 1..2281: note = Synthetic polypeptide
  source 1..2281: mol_type = other DNA

SEQ ID NO: 16379 - DNA, 700 bp, synthetic construct
  misc_feature 1..700: note = Synthetic polypeptide
  source 1..700: mol_type = other DNA
ggccaggcacggtggctcacgcctgtaatcccagtactttgggaggccgaggcgggtggatcacctgaggtcaggagttcgagaccagcctggccaacatggcgaaaccccgtctctactaaaaaatacaaaaattagccgtgcgtggcggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctga

SEQ ID NO: 16380 - DNA, 298 bp, synthetic construct
  misc_feature 1..298: note = Synthetic polypeptide
  source 1..298: mol_type = other DNA
ggccaggcacggtggctcacgcctgtaatcccagtactttgggaggccgaggcgggtggatcacctgaggtcaggagttcgagaccagcctggccaacatggcgaaaccccgtctctactaaaaaatacaaaaattagccgtgcgtggcggtcctacatcgccaatcgagtgactgacaagctgacacctattcacgaccgcattttctgctgtcgctcaggctcagctgctgatacccaggcagtagctgatgctgtcacctaccagctcggtttccacagcagccagcctctttaa

SEQ ID NO: 16381 - DNA, 414 bp, synthetic construct
  misc_feature 1..414: note = Synthetic polypeptide
  source 1..414: mol_type = other DNA
ggccaggcgcagtggctcatgcctgtaatcccagcaaggatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 16382 - DNA, 1372 bp, synthetic construct
  misc_feature 1..1372: note = Synthetic polypeptide
  source 1..1372: mol_type = other DNA
gaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggcggcatctggaggtagcagaagtagcagcagcccactggtggtagtgtctgtgaagtctcccaatcagagtctccgccttggcttgtccagattagcacgagttaaacctttgcatccaaatgccactagcacctga

SEQ ID NO: 16383 - DNA, 1522 bp, synthetic construct
  misc_feature 1..1522: note = Synthetic polypeptide
  source 1..1522: mol_type = other DNA
gaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctga

SEQ ID NO: 16384 - DNA, 2502 bp, synthetic construct; identical to SEQ ID NO: 8603
  misc_feature 1..2502: note = Synthetic polypeptide
  source 1..2502: mol_type = other DNA

SEQ ID NO: 16385 - DNA, 441 bp, synthetic construct; identical to SEQ ID NO: 8604
  misc_feature 1..441: note = Synthetic polypeptide
  source 1..441: mol_type = other DNA

SEQ ID NO: 16386 - DNA, 2454 bp, synthetic construct; identical to SEQ ID NO: 8605
  misc_feature 1..2454: note = Synthetic polypeptide
  source 1..2454: mol_type = other DNA

SEQ ID NO: 16387 - DNA, 1736 bp, synthetic construct
  misc_feature 1..1736: note = Synthetic polypeptide
  source 1..1736: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtga

SEQ ID NO: 16388 - DNA, 1607 bp, synthetic construct
  misc_feature 1..1607: note = Synthetic polypeptide
  source 1..1607: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtga

SEQ ID NO: 16389 - DNA, 581 bp, synthetic construct
  misc_feature 1..581: note = Synthetic polypeptide
  source 1..581: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagctga

SEQ ID NO: 16390 - DNA, 842 bp, synthetic construct
  misc_feature 1..842: note = Synthetic polypeptide
  source 1..842: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcgg

SEQ ID NO: 16391 - DNA, 761 bp, synthetic construct
  misc_feature 1..761: note = Synthetic polypeptide
  source 1..761: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactc

SEQ ID NO: 16392 - DNA, 745 bp, synthetic construct
  misc_feature 1..745: note = Synthetic polypeptide
  source 1..745: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgactt

SEQ ID NO: 16393 - DNA, 692 bp, synthetic construct
  misc_feature 1..692: note = Synthetic polypeptide
  source 1..692: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgag

SEQ ID NO: 16394 - DNA, 691 bp, synthetic construct
  misc_feature 1..691: note = Synthetic polypeptide
  source 1..691: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactga

SEQ ID NO: 16395 - DNA, 688 bp, synthetic construct
  misc_feature 1..688: note = Synthetic polypeptide
  source 1..688: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgac

SEQ ID NO: 16396 - DNA, 681 bp, synthetic construct
  misc_feature 1..681: note = Synthetic polypeptide
  source 1..681: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcct

SEQ ID NO: 16397 - DNA, 649 bp, synthetic construct
  misc_feature 1..649: note = Synthetic polypeptide
  source 1..649: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccat

SEQ ID NO: 16398 - DNA, 637 bp, synthetic construct
  misc_feature 1..637: note = Synthetic polypeptide
  source 1..637: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccagg

SEQ ID NO: 16399 - DNA, 612 bp, synthetic construct
  misc_feature 1..612: note = Synthetic polypeptide
  source 1..612: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgcca

SEQ ID NO: 16400 - DNA, 588 bp, synthetic construct
  misc_feature 1..588: note = Synthetic polypeptide
  source 1..588: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtgga

SEQ ID NO: 16401 - DNA, 580 bp, synthetic construct
  misc_feature 1..580: note = Synthetic polypeptide
  source 1..580: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagaggga

SEQ ID NO: 16402 - DNA, 577 bp, synthetic construct
  misc_feature 1..577: note = Synthetic polypeptide
  source 1..577: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagag

SEQ ID NO: 16403 - DNA, 491 bp, synthetic construct
  misc_feature 1..491: note = Synthetic polypeptide
  source 1..491: mol_type = other DNA
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagagg

SEQ ID NO: 16404 - DNA, 1407 bp, synthetic construct; identical to SEQ ID NO: 9548
  misc_feature 1..1407: note = Synthetic polypeptide
  source 1..1407: mol_type = other DNA

SEQ ID NO: 16405 - DNA, 3448 bp, synthetic construct
  misc_feature 1..3448: note = Synthetic polypeptide
  source 1..3448: mol_type = other DNA
caggcatacctcatattattgtgctttattttatcacacctcacagatacagcgttttatacaaattgaaggtttgtggtaatcctgtgttgaacaagtctgttggtgccatttttcaaaaagtatgtgcttacttcatgtttctgtgccacattctggtaattcttccaatatttccaacttattttactgttgctttgctgctattgtaattgttttggcatgccacaaaccattcccatgtaagatggtgaacttaattgataaactttgtgtatgctgtgactgctccaccagtcggccgttctcctgtctctctcccactttcttgggcctccctctttcctgacacacaacaaaattgaaattaggaaaattaataaccctacaatggcctctaagtgttcaagtgaagggaagagtcacatgtgtctcagtttacatcaaaaactagaaatgatgaagcttagtgaggaagacatgtcgaaagctgtggtaggccgaaagttaggcctcttgttccaaatagtcaagctgtgaatgcaaggcacaagttcctgcagtaaactaaaagggctactcaggtaagcacatgaatgataagaaagcaagacaggctttttgctgatatgggaaagtttgagtagtcgagatagaagatcagatcagccacaacattcccttatgccaaaacttaatccagaggaaggccctaacactcttctgagaaggctgagagaggtgaggaagctgcacaagaaaatttggaagctagcagaggttggttcatgaggtttttctttttcttttcttttcttttctttttttttggttcatgaggtttaagggaagaagctgtctccgtaacataaatgtgcaagatgaagcagcaagtgctgatggagaagctgcagcaagttacccagaagatctagctaagatcattggtaagatggctacactcaacaacagattctcaatgtagatgaaaacagccttctcttggaagaagatgccatctaggactttcctagctagagaggaaaagtcagtttctggcttcaaagctttgaagaacaggctgattctcttgttacaggctaatgaaactggtaactttaaagttgaggccagtgcttaccgaccattctgaagattctagggcccttaagaaacatgctaaatctactctgcctgtgctctataaatggaacaataaagtcatgacagcacatctgtttgcactatggctaactgaatgtttaaagcccactgttgagacttactgtacagacaagaagggattcctttcataatattactgctcattaacaatgcacttggtcactcgagctttgatggagatgtacaaggagattaatgatttcatgcctgctgacacaagatcagttttgcagcctatggatcaaggagtaatttttactttcaagtcttattatttaagaaatacatttcataaggctagagctgccattgatagttattcctttgatggatctgggaaaaccttctggaaaggattcattattctagatactgttaagaacatttgtgatgcatgggaggaggtaaaaatattaacatgaataggaatttggaagaagttgattccaaacttcatagatgactttgaggggttctcactgcttcagtggaggaagtaactacacacgtggtggaaatagcaagagaagtaggattaaaagtggagcctgaagatgtgactgaatttgctgcaatctcatgataaaacttgggatgaattgcttcttacagatgaatggtttattgatagaatctactcctggtgcagatgctgtgaacatttttgttgaagacaacaaaggatttagaatttccacataaagttagttgataaagcagaggcagagtttgagaggattgactccaattttgaaagttctcctatgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctag

SEQ ID NO: 16406 - DNA, 3463 bp, synthetic construct
  misc_feature 1..3463: note = Synthetic polypeptide
  source 1..3463: mol_type = other DNA
caggcatacctcatattattgtgctttattttatcacacctcacagatacagcgttttatacaaattgaaggtttgtggtaatcctgtgttgaacaagtctgttggtgccatttttcaaaaagtatgtgcttacttcatgtttctgtgccacattctggtaattcttccaatatttccaacttattttactgttgctttgctgctattgtaattgttttggcatgccacaaaccattcccatgtaagatggtgaacttaattgataaactttgtgtatgctgtgactgctccaccagtcggccgttctcctgtctctctcccactttcttgggcctccctctttcctgacacacaacaaaattgaaattaggaaaattaataaccctacaatggcctctaagtgttcaagtgaagggaagagtcacatgtgtctcagtttacatcaaaaactagaaatgatgaagcttagtgaggaagacatgtcgaaagctgtggtaggccgaaagttaggcctcttgttccaaatagtcaagctgtgaatgcaaggcacaagttcctgcagtaaactaaaagggctactcaggtaagcacatgaatgataagaaagcaagacaggctttttgctgatatgggaaagtttgagtagtcgagatagaagatcagatcagccacaacattcccttatgccaaaacttaatccagaggaaggccctaacactcttctgagaaggctgagagaggtgaggaagctgcacaagaaaatttggaagctagcagaggttggttcatgaggtttttctttttcttttcttttcttttctttttttttggttcatgaggtttaagggaagaagctgtctccgtaacataaatgtgcaagatgaagcagcaagtgctgatggagaagctgcagcaagttacccagaagatctagctaagatcattggtaagatggctacactcaacaacagattctcaatgtagatgaaaacagccttctcttggaagaagatgccatctaggactttcctagctagagaggaaaagtcagtttctggcttcaaagctttgaagaacaggctgattctcttgttacaggctaatgaaactggtaactttaaagttgaggccagtgcttaccgaccattctgaagattctagggcccttaagaaacatgctaaatctactctgcctgtgctctataaatggaacaataaagtcatgacagcacatctgtttgcactatggctaactgaatgtttaaagcccactgttgagacttactgtacagacaagaagggattcctttcataatattactgctcattaacaatgcacttggtcactcgagctttgatggagatgtacaaggagattaatgatttcatgcctgctgacacaagatcagttttgcagcctatggatcaaggagtaatttttactttcaagtcttattatttaagaaatacatttcataaggctagagctgccattgatagttattcctttgatggatctgggaaaaccttctggaaaggattcattattctagatactgttaagaacatttgtgatgcatgggaggaggtaaaaatattaacatgaataggaatttggaagaagttgattccaaacttcatagatgactttgaggggttctcactgcttcagtggaggaagtaactacacacgtggtggaaatagcaagagaagtaggattaaaagtggagcctgaagatgtgactgaatttgctgcaatctcatgataaaacttgggatgaattgcttcttacagatgaatggtttattgatagaatctactcctggtgcagatgctgtgaacatttttgttgaagacaacaaaggatttagaatttccacataaagttagttgataaagcagaggcagagtttgagaggattgactccaattttgaaagttctcctatgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctag

SEQ ID NO: 16407 - DNA, 1482 bp, synthetic construct
  misc_feature 1..1482: note = Synthetic polypeptide
  source 1..1482: mol_type = other DNA
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattag

SEQ ID NO: 16408 - DNA, 1338 bp, synthetic construct
  misc_feature 1..1338: note = Synthetic polypeptide
  source 1..1338: mol_type = other DNA
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttccacctggagatcctttcacaccgagcggaagacagaaccagccacaggtttcatcgacggtga

SEQ ID NO: 16409 - DNA, 459 bp, synthetic construct
  misc_feature 1..459: note = Synthetic polypeptide
  source 1..459: mol_type = other DNA
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaa

SEQ ID NO: 16410 - DNA, 2334 bp, synthetic construct
  misc_feature 1..2334: note = Synthetic polypeptide
  source 1..2334: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16411 - DNA, 2109 bp, synthetic construct
  misc_feature 1..2109: note = Synthetic polypeptide
  source 1..2109: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16412 - DNA, 2277 bp, synthetic construct
  misc_feature 1..2277: note = Synthetic polypeptide
  source 1..2277: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16413 - DNA, 2280 bp, synthetic construct
  misc_feature 1..2280: note = Synthetic polypeptide
  source 1..2280: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16414 - DNA, 2166 bp, synthetic construct
  misc_feature 1..2166: note = Synthetic polypeptide
  source 1..2166: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16415 - DNA, 1713 bp, synthetic construct
  misc_feature 1..1713: note = Synthetic polypeptide
  source 1..1713: mol_type = other DNA
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttga

SEQ ID NO: 16416 - DNA, 1571 bp, synthetic construct; identical to SEQ ID NO: 6810
  misc_feature 1..1571: note = Synthetic polypeptide
  source 1..1571: mol_type = other DNA

SEQ ID NO: 16417 - DNA, 2059 bp, synthetic construct
  misc_feature 1..2059: note = Synthetic polypeptide
  source 1..2059: mol_type = other DNA
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 16418 - DNA, 639 bp, synthetic construct
  misc_feature 1..639: note = Synthetic polypeptide
  source 1..639: mol_type = other DNA
ggccagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatga

SEQ ID NO: 16419 - DNA, 816 bp, synthetic construct
  misc_feature 1..816: note = Synthetic polypeptide
  source 1..816: mol_type = other DNA
ggccagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtga

SEQ ID NO: 16420 - DNA, 1458 bp, synthetic construct; identical to SEQ ID NO: 9425
  misc_feature 1..1458: note = Synthetic polypeptide
  source 1..1458: mol_type = other DNA

SEQ ID NO: 16421 - DNA, 2390 bp, synthetic construct
  misc_feature 1..2390: note = Synthetic polypeptide
  source 1..2390: mol_type = other DNA
tcaccaaaatgtaacaggttatttctaggtggcggaattgaagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctag

SEQ ID NO: 16422 - DNA, 370 bp, synthetic construct; identical to SEQ ID NO: 6522
  misc_feature 1..370: note = Synthetic polypeptide
  source 1..370: mol_type = other DNA

SEQ ID NO: 16423 - DNA, 1054 bp, synthetic construct
  misc_feature 1..1054: note = Synthetic polypeptide
  source 1..1054: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16424 - DNA, 1120 bp, synthetic construct
  misc_feature 1..1120: note = Synthetic polypeptide
  source 1..1120: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16425 - DNA, 1189 bp, synthetic construct
  misc_feature 1..1189: note = Synthetic polypeptide
  source 1..1189: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16426 - DNA, 1048 bp, synthetic construct
  misc_feature 1..1048: note = Synthetic polypeptide
  source 1..1048: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16427 - DNA, 500 bp, synthetic construct
  misc_feature 1..500: note = Synthetic polypeptide
  source 1..500: mol_type = other DNA
ggccgggcacagtggctcacacctgtaatcccagccctttgggaggccaaggagtgcggatcacctgaggtcaggagttcgagaccagcccgaccaacatgctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatga

SEQ ID NO: 16428 - DNA, 576 bp, synthetic construct; identical to SEQ ID NO: 9577
  misc_feature 1..576: note = Synthetic polypeptide
  source 1..576: mol_type = other DNA

SEQ ID NO: 16429 - DNA, 570 bp, synthetic construct; identical to SEQ ID NO: 9578
  misc_feature 1..570: note = Synthetic polypeptide
  source 1..570: mol_type = other DNA

SEQ ID NO: 16430 - DNA, 573 bp, synthetic construct; identical to SEQ ID NO: 9579
  misc_feature 1..573: note = Synthetic polypeptide
  source 1..573: mol_type = other DNA

SEQ ID NO: 16431 - DNA, 738 bp, synthetic construct; identical to SEQ ID NO: 7971
  misc_feature 1..738: note = Synthetic polypeptide
  source 1..738: mol_type = other DNA

SEQ ID NO: 16432 - DNA, 816 bp, synthetic construct; identical to SEQ ID NO: 7972
  misc_feature 1..816: note = Synthetic polypeptide
  source 1..816: mol_type = other DNA

SEQ ID NO: 16433 - DNA, 750 bp, synthetic construct; identical to SEQ ID NO: 7973
  misc_feature 1..750: note = Synthetic polypeptide
  source 1..750: mol_type = other DNA

SEQ ID NO: 16434 - DNA, 783 bp, synthetic construct; identical to SEQ ID NO: 7974
  misc_feature 1..783: note = Synthetic polypeptide
  source 1..783: mol_type = other DNA

SEQ ID NO: 16435 - DNA, 711 bp, synthetic construct; identical to SEQ ID NO: 7377
  misc_feature 1..711: note = Synthetic polypeptide
  source 1..711: mol_type = other DNA

SEQ ID NO: 16436 - DNA, 2513 bp, synthetic construct; identical to SEQ ID NO: 9639
  misc_feature 1..2513: note = Synthetic polypeptide
  source 1..2513: mol_type = other DNA

SEQ ID NO: 16437 - DNA, 804 bp, synthetic construct
  misc_feature 1..804: note = Synthetic polypeptide
  source 1..804: mol_type = other DNA
gtggaatgacaggatggaggaagctttggtgcctgacatcagagtcgccataccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtga

SEQ ID NO: 16438 - DNA, 1007 bp, synthetic construct; identical to SEQ ID NO: 7489
  misc_feature 1..1007: note = Synthetic polypeptide
  source 1..1007: mol_type = other DNA

SEQ ID NO: 16439 - DNA, 140 bp, synthetic construct
  misc_feature 1..140: note = Synthetic polypeptide
  source 1..140: mol_type = other DNA
ggccaggtctcaacaaatggcagctattacatcagacagtgacgagtcctgctgctcccttacagtgtctgacagaccactgtggattcagactgggagcattgaagttaacagtgaaacgggcagcacaaagacattag

SEQ ID NO: 16440 - DNA, 981 bp, synthetic construct; identical to SEQ ID NO: 12548
  misc_feature 1..981: note = Synthetic polypeptide
  source 1..981: mol_type = other DNA

SEQ ID NO: 16441 - DNA, 1505 bp, synthetic construct; identical to SEQ ID NO: 9488
  misc_feature 1..1505: note = Synthetic polypeptide
  source 1..1505: mol_type = other DNA

SEQ ID NO: 16442 - DNA, 2622 bp, synthetic construct
  misc_feature 1..2622: note = Synthetic polypeptide
  source 1..2622: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtga

SEQ ID NO: 16443 - DNA, 1218 bp, synthetic construct
  misc_feature 1..1218: note = Synthetic polypeptide
  source 1..1218: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttggaggagttctctggccacaccgttggtacagcagctccttccaggctcattcatggaacaggcatggtggcagtcttggagaagagtgccagccccggtcagagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatga

SEQ ID NO: 16444 - DNA, 1125 bp, synthetic construct
  misc_feature 1..1125: note = Synthetic polypeptide
  source 1..1125: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttggattttggatctggggtaaaggaggagttctctggccacaccgttggtacagcagctccttccaggctcattcatggaacaggcatggtggcagtcttggagaagagtgccagccccggtcagagggaagaaatgaatcctgcattccatttcaaagaaaagatgagaatcccatctccccagtgacatccaatgccttcttccaactttgctga

SEQ ID NO: 16445 - DNA, 2234 bp, synthetic construct
  misc_feature 1..2234: note = Synthetic polypeptide
  source 1..2234: mol_type = other DNA
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaa

SEQ ID NO: 16446 - DNA, 2348 bp, synthetic construct
  misc_feature 1..2348: note = Synthetic polypeptide
  source 1..2348: mol_type = other DNA
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaa

SEQ ID NO: 16447 - DNA, 917 bp, synthetic construct
  misc_feature 1..917: note = Synthetic polypeptide
  source 1..917: mol_type = other DNA
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatga

SEQ ID NO: 16448 - DNA, 2039 bp, synthetic construct
  misc_feature 1..2039: note = Synthetic polypeptide
  source 1..2039: mol_type = other DNA
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctga

SEQ ID NO: 16449 - DNA, 1752 bp, synthetic construct
  misc_feature 1..1752: note = Synthetic polypeptide
  source 1..1752: mol_type = other DNA
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatag

SEQ ID NO: 16450 - DNA, 1689 bp, synthetic construct
  misc_feature 1..1689: note = Synthetic polypeptide
  source 1..1689: mol_type = other DNA
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatag

SEQ ID NO: 16451 - DNA, 1643 bp, synthetic construct
  misc_feature 1..1643: note = Synthetic polypeptide
  source 1..1643: mol_type = other DNA
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagc

SEQ ID NO: 16452 - DNA, 11880 bp, synthetic construct
  misc_feature 1..11880: note = Synthetic polypeptide
  source 1..11880: mol_type = other DNA
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 16453 - DNA, 1125 bp, synthetic construct
  misc_feature 1..1125: note = Synthetic polypeptide
  source 1..1125: mol_type = other DNA
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 16454 - DNA, 945 bp, synthetic construct
  misc_feature 1..945: note = Synthetic polypeptide
  source 1..945: mol_type = other DNA
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaaggaataccagaaacacatggaaacttttgac

SEQ ID NO: 16455 - DNA, 3165 bp, synthetic construct
  misc_feature 1..3165: note = Synthetic polypeptide
  source 1..3165: mol_type = other DNA
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaa

SEQ ID NO: 16456 - DNA, 1498 bp, synthetic construct; identical to SEQ ID NO: 8305
  misc_feature 1..1498: note = Synthetic polypeptide
  source 1..1498: mol_type = other DNA

SEQ ID NO: 16457 - DNA, 1195 bp, synthetic construct; identical to SEQ ID NO: 8306
  misc_feature 1..1195: note = Synthetic polypeptide
  source 1..1195: mol_type = other DNA

SEQ ID NO: 16458 - DNA, 1462 bp, synthetic construct; identical to SEQ ID NO: 8307
  misc_feature 1..1462: note = Synthetic polypeptide
  source 1..1462: mol_type = other DNA

SEQ ID NO: 16459 - DNA, 1489 bp, synthetic construct; identical to SEQ ID NO: 8308
  misc_feature 1..1489: note = Synthetic polypeptide
  source 1..1489: mol_type = other DNA

SEQ ID NO: 16460 - DNA, 1180 bp, synthetic construct; identical to SEQ ID NO: 8309
  misc_feature 1..1180: note = Synthetic polypeptide
  source 1..1180: mol_type = other DNA

SEQ ID NO: 16461 - DNA, 1808 bp, synthetic construct; identical to SEQ ID NO: 8393
  misc_feature 1..1808: note = Synthetic polypeptide
  source 1..1808: mol_type = other DNA

SEQ ID NO: 16462 - DNA, 1593 bp, synthetic construct
  misc_feature 1..1593: note = Synthetic polypeptide
  source 1..1593: mol_type = other DNA
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatag

SEQ ID NO: 16463 - DNA, 243 bp, synthetic construct
  misc_feature 1..243: note = Synthetic polypeptide
  source 1..243: mol_type = other DNA
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctgctgtga

SEQ ID NO: 16464 - DNA, 429 bp, synthetic construct
  misc_feature 1..429: note = Synthetic polypeptide
  source 1..429: mol_type = other DNA
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacggaagaagatcaagctgagtgggctggccctggaccacaaggtgacaggtga

SEQ ID NO: 16465 - DNA, 691 bp, synthetic construct
  misc_feature 1..691: note = Synthetic polypeptide
  source 1..691: mol_type = other DNA
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgaga

SEQ ID NO: 16466 - DNA, 245 bp, synthetic construct
  misc_feature 1..245: note = Synthetic polypeptide
  source 1..245: mol_type = other DNA
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcag

SEQ ID NO: 16467 - DNA, 1073 bp, synthetic construct
  misc_feature 1..1073: note = Synthetic polypeptide
  source 1..1073: mol_type = other DNA
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatga

SEQ ID NO: 16468 - DNA, 2375 bp, synthetic construct
  misc_feature 1..2375: note = Synthetic polypeptide
  source 1..2375: mol_type = other DNA
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctga

SEQ ID NO: 16469 - DNA, 1685 bp, synthetic construct
  misc_feature 1..1685: note = Synthetic polypeptide
  source 1..1685: mol_type = other DNA
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaaggtgagtggcagcccgaggagggcaggggtggcaggccaggccgacgccccctccccgcccctcctggtttcccagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactga

SEQ ID NO: 16470 - DNA, 796 bp, synthetic construct
  misc_feature 1..796: note = Synthetic polypeptide
  source 1..796: mol_type = other DNA
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggg

SEQ ID NO: 16471 - DNA, 1585 bp, synthetic construct; identical to SEQ ID NO: 9497
  misc_feature 1..1585: note = Synthetic polypeptide
  source 1..1585: mol_type = other DNA

SEQ ID NO: 16472 - DNA, 70 bp, synthetic construct
  misc_feature 1..70: note = Synthetic polypeptide
  source 1..70: mol_type = other DNA
ggcagggcacggtggctcatgcctgtaatcccaggactttgggaggccgagcaaacttcaaggcttttga

SEQ ID NO: 16473 - DNA, 2165 bp, synthetic construct; identical to SEQ ID NO: 9527
  misc_feature 1..2165: note = Synthetic polypeptide
  source 1..2165: mol_type = other DNA

SEQ ID NO: 16474 - DNA, 1967 bp, synthetic construct; identical to SEQ ID NO: 7428
  misc_feature 1..1967: note = Synthetic polypeptide
  source 1..1967: mol_type = other DNA

SEQ ID NO: 16475 - DNA, 1142 bp, synthetic construct; identical to SEQ ID NO: 7429
  misc_feature 1..1142: note = Synthetic polypeptide
  source 1..1142: mol_type = other DNA

SEQ ID NO: 16476 - DNA, 377 bp, synthetic construct
  misc_feature 1..377: note = Synthetic polypeptide
  source 1..377: mol_type = other DNA
gctgggcacggtggctggcgcctgtaatcccagcactttgggaggccgagacgggtggatcacctgagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16477 - DNA, 399 bp, synthetic construct
  misc_feature 1..399: note = Synthetic polypeptide
  source 1..399: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaag

SEQ ID NO: 16478 - DNA, 532 bp, synthetic construct
  misc_feature 1..532: note = Synthetic polypeptide
  source 1..532: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatga

SEQ ID NO: 16479 - DNA, 433 bp, synthetic construct
  misc_feature 1..433: note = Synthetic polypeptide
  source 1..433: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaaggtctcgctctctctcacaggctggagtgcagtga

SEQ ID NO: 16480 - DNA, 490 bp, synthetic construct
  misc_feature 1..490: note = Synthetic polypeptide
  source 1..490: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatga

SEQ ID NO: 16481 - DNA, 286 bp, synthetic construct
  misc_feature 1..286: note = Synthetic polypeptide
  source 1..286: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgcaagaataa

SEQ ID NO: 16482 - DNA, 232 bp, synthetic construct
  misc_feature 1..232: note = Synthetic polypeptide
  source 1..232: mol_type = other DNA
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctga

SEQ ID NO: 16483 - DNA, 1261 bp, synthetic construct
  misc_feature 1..1261: note = Synthetic polypeptide
  source 1..1261: mol_type = other DNA
ggccaggcatggtggctcacgcctgtaatcccaggactttgggaggctgaggcaggtggatcacctgaggtcaggagttcgagaccagcctgaccaacatggtgaaaccccgtctctacaaaagtacaaaaattagcccggcatgatggcgggtacctgtaatcccagctactcgggaggctgaggcagaagaatcacttgaacctgggaggcagaggttgcagttagccgggattgtgccattgcactctagcctagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaa

SEQ ID NO: 16484 - DNA, 2940 bp, synthetic construct
  misc_feature 1..2940: note = Synthetic polypeptide
  source 1..2940: mol_type = other DNA
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctag

SEQ ID NO: 16485 - DNA, 1620 bp, synthetic construct
  misc_feature 1..1620: note = Synthetic polypeptide
  source 1..1620: mol_type = other DNA
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagattataa

SEQ ID NO: 16486 - DNA, 954 bp, synthetic construct
  misc_feature 1..954: note = Synthetic polypeptide
  source 1..954: mol_type = other DNA
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgaggtacattcatatttacagtga

SEQ ID NO: 16487 - DNA, 3642 bp, synthetic construct
  misc_feature 1..3642: note = Synthetic polypeptide
  source 1..3642: mol_type = other DNA
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattga

SEQ ID NO: 16488 - DNA, 3669 bp, synthetic construct
  misc_feature 1..3669: note = Synthetic polypeptide
  source 1..3669: mol_type = other DNA
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtag

SEQ ID NO: 16489 - DNA, 347 bp, synthetic construct
  misc_feature 1..347: note = Synthetic polypeptide
  source 1..347: mol_type = other DNA
ggctgggcttggtggctcacgcctgtaatcccagcactttgggaggcagctggatcatgagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataa

SEQ ID NO: 16490 - DNA, 269 bp, synthetic construct
  misc_feature 1..269: note = Synthetic polypeptide
  source 1..269: mol_type = other DNA
ggctgggcttggtggctcacgcctgtaatcccagcactttgggaggcagctggatcatgagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaa

SEQ ID NO: 16491 - DNA, 198 bp, synthetic construct
  misc_feature 1..198: note = Synthetic polypeptide
  source 1..198: mol_type = other DNA
ggctgggcttggtggctcacgcctgtaatcccagcactttgggaggcagctggatcatgagacatgcgaaaagaaccacaattaacactgaagatgtgaagctcttagccaggaggagtaattcactgctaaaatacatcacagacaaaagtgaagagattgctcagattaacctagaacgaaaagcacagaagaaaa

SEQ ID NO: 16492 - DNA, 1464 bp, synthetic construct; identical to SEQ ID NO: 9124
  misc_feature 1..1464: note = Synthetic polypeptide
  source 1..1464: mol_type = other DNA

SEQ ID NO: 16493 - DNA, 379 bp, synthetic construct
  misc_feature 1..379: note = Synthetic polypeptide
  source 1..379: mol_type = other DNA
tgagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttga

SEQ ID NO: 16494 - DNA, 447 bp, synthetic construct
  misc_feature 1..447: note = Synthetic polypeptide
  source 1..447: mol_type = other DNA
tttggtgccgtgacttggatcagggacctcccttgggagatcaatcccctgtcctcctgctctttgctctgtgagaaagatccacctacgacctcaggtcctcagaccgaccagcccaagaaacatctcaccaatttcaaatccggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 16495 - DNA, 2609 bp, synthetic construct; identical to SEQ ID NO: 8660
  misc_feature 1..2609: note = Synthetic polypeptide
  source 1..2609: mol_type = other DNA

SEQ ID NO: 16496 - DNA, 2360 bp, synthetic construct; identical to SEQ ID NO: 8661
  misc_feature 1..2360: note = Synthetic polypeptide
  source 1..2360: mol_type = other DNA

SEQ ID NO: 16497 - DNA, 2753 bp, synthetic construct; identical to SEQ ID NO: 8662
  misc_feature 1..2753: note = Synthetic polypeptide
  source 1..2753: mol_type = other DNA

SEQ ID NO: 16498 - DNA, 2291 bp, synthetic construct; identical to SEQ ID NO: 8663
  misc_feature 1..2291: note = Synthetic polypeptide
  source 1..2291: mol_type = other DNA

SEQ ID NO: 16499 - DNA, 2255 bp, synthetic construct; identical to SEQ ID NO: 8664
  misc_feature 1..2255: note = Synthetic polypeptide
  source 1..2255: mol_type = other DNA

SEQ ID NO: 16500 - DNA, 2510 bp, synthetic construct; identical to SEQ ID NO: 8665
  misc_feature 1..2510: note = Synthetic polypeptide
  source 1..2510: mol_type = other DNA

SEQ ID NO: 16501 - DNA, 2348 bp, synthetic construct; identical to SEQ ID NO: 8666
  misc_feature 1..2348: note = Synthetic polypeptide
  source 1..2348: mol_type = other DNA

SEQ ID NO: 16502 - DNA, 2417 bp, synthetic construct; identical to SEQ ID NO: 8667
  misc_feature 1..2417: note = Synthetic polypeptide
  source 1..2417: mol_type = other DNA

SEQ ID NO: 16503 - DNA, 2690 bp, synthetic construct; identical to SEQ ID NO: 8668
  misc_feature 1..2690: note = Synthetic polypeptide
  source 1..2690: mol_type = other DNA

SEQ ID NO: 16504 - DNA, 2741 bp, synthetic construct; identical to SEQ ID NO: 8669
  misc_feature 1..2741: note = Synthetic polypeptide
  source 1..2741: mol_type = other DNA

SEQ ID NO: 16505 - DNA, 799 bp, synthetic construct; identical to SEQ ID NO: 8670
  misc_feature 1..799: note = Synthetic polypeptide
  source 1..799: mol_type = other DNA

SEQ ID NO: 16506 - DNA, 1786 bp, synthetic construct
  misc_feature 1..1786: note = Synthetic polypeptide
  source 1..1786: mol_type = other DNA
ctttgcttctcatcaaacagacaaaactctgccactttggggcatctgtgctttctgttccctcagtcctggaacgttctccccatgacctgctgcataaatgggctgtttcttctgcaagctcagctggaatgttaccgcttcagagaccttcttggaaccccccaactcagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggcaccgactcattggtcactcatctgctgaatgtatcctctcgggcaatactgcccattggagcatgaagccaccaatttgtcaacaaatcttttgtccaaatcctccagctatccttaatgggagacacacaggaactccccttggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaa

SEQ ID NO: 16507 - DNA, 1553 bp, synthetic construct
  misc_feature 1..1553: note = Synthetic polypeptide
  source 1..1553: mol_type = other DNA
taccttgcttgtggtaatgcacaatggtacagccattctggaaaaccagttgggaggtttctttaggtgaaacatatacttagaattagcccagcaatcccactcttaggtgtttgccatcgagaaatgaaaacttatgtttgcacaaaaatctgtacatgtttatagcagctcttttcataatcttcaagaaatggaaacaacccaaatgcctttcaatgaatggatgaatggtggtacattccatacaacgaaatatgactcagtaataaacacacctaataccttgggtgaacctcgggcattatctgaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactga

SEQ ID NO: 16508 - DNA, 198 bp, synthetic construct
  misc_feature 1..198: note = Synthetic polypeptide
  source 1..198: mol_type = other DNA
ggctggacgtggtggctcatacttgtattcctagcactttgggaggctgatacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttga

SEQ ID NO: 16509 - DNA, 504 bp, synthetic construct; identical to SEQ ID NO: 7011
  misc_feature 1..504: note = Synthetic polypeptide
  source 1..504: mol_type = other DNA

SEQ ID NO: 16510 - DNA, 2153 bp, synthetic construct; identical to SEQ ID NO: 7012
  misc_feature 1..2153: note = Synthetic polypeptide
  source 1..2153: mol_type = other DNA

SEQ ID NO: 16511 - DNA, 818 bp, synthetic construct; identical to SEQ ID NO: 7013
  misc_feature 1..818: note = Synthetic polypeptide
  source 1..818: mol_type = other DNA

SEQ ID NO: 16512 - DNA, 1446 bp, synthetic construct; identical to SEQ ID NO: 8572
  misc_feature 1..1446: note = Synthetic polypeptide
  source 1..1446: mol_type = other DNA

SEQ ID NO: 16513 - DNA, 104 bp, synthetic construct; identical to SEQ ID NO: 8573
  misc_feature 1..104: note = Synthetic polypeptide
  source 1..104: mol_type = other DNA

SEQ ID NO: 16514 - DNA, 489 bp, synthetic construct; identical to SEQ ID NO: 8574
  misc_feature 1..489: note = Synthetic polypeptide
  source 1..489: mol_type = other DNA

SEQ ID NO: 16515 - DNA, 700 bp, synthetic construct
  misc_feature 1..700: note = Synthetic polypeptide
  source 1..700: mol_type = other DNA
gccaggagcggtggctcacccctgtaatcccagcactttgagatgcagaggcgggcggatcatttgaggccaggagttcgagaccaacctggccaacatggcgaaacgctgtctctactaaaaatacaaaaaaattacctggcatggtggtgcacgcctgtaatcccagctactcgagaggctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataa

SEQ ID NO: 16516 - DNA, 2505 bp, synthetic construct
  misc_feature 1..2505: note = Synthetic polypeptide
  source 1..2505: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtga

SEQ ID NO: 16517 - DNA, 1101 bp, synthetic construct
  misc_feature 1..1101: note = Synthetic polypeptide
  source 1..1101: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttggaggagttctctggccacaccgttggtacagcagctccttccaggctcattcatggaacaggcatggtggcagtcttggagaagagtgccagccccggtcagagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatga

SEQ ID NO: 16518 - DNA, 1008 bp, synthetic construct
  misc_feature 1..1008: note = Synthetic polypeptide
  source 1..1008: mol_type = other DNA
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttggattttggatctggggtaaaggaggagttctctggccacaccgttggtacagcagctccttccaggctcattcatggaacaggcatggtggcagtcttggagaagagtgccagccccggtcagagggaagaaatgaatcctgcattccatttcaaagaaaagatgagaatcccatctccccagtgacatccaatgccttcttccaactttgctga

SEQ ID NO: 16519 - DNA, 2839 bp, synthetic construct
  misc_feature 1..2839: note = Synthetic polypeptide
  source 1..2839: mol_type = other DNA
caggttatgaaacaaattgattctagcaggccagacataagagagatgattccctggaccatcccaaggaagagtggttaacagatgcaagttgttttatgcatcaggaaaacaggagggctaaatatgctattattagcacaagagaatcaatcaaggcacaagccttgctggcttcgacctcagcagctcaaaaagctgagttaattgaactaactaggcccctgcagttgggaaagaatttaaaagttaacatttacactgattccaagtatgattttttagtgcttcatgcttatgctgcaatttggaatgggtggggactcctgacccccaagggcttttccatacaacatcgttcagattttgagcttgttagagtgctgctttgctgccaaaaagtgagtataattaattgcagaggacatcaaaagagagactgaccatgtaaaaggaaatgcccttgtagatgccacagccaaggcccctgcactgaaagggccaatgaagcttgtgggcgtgctggtcagcatacatagaactgggccagaataccctgaagaagaacgaaaatgggccagggattgcatttcagtccagggcccctcgggctgaatgatggtaataaattactaatgccaagtaccaatcacaggagtataactcagcactttcatgattcttttcaccctagaagggattctttgtttctgttaatgtctcatttgtttataggggtaaatcttttcaagacactaaaacaggtgactcagccctgtgagctttgtgcctgacatgactcaaatggccagcaattttctccttctccagttaaacctgtccaaaattgaggaacctatccaggtgagaactggccactctaatttacccggaagcctttctgcaggagattcaaatatttgctaatgcttactgacaccttcactggttagatcgaggcattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctag

SEQ ID NO: 16520 - DNA, 999 bp, synthetic construct
  misc_feature 1..999: note = Synthetic polypeptide
  source 1..999: mol_type = other DNA
gttactgatcagctccacgactttaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtag

SEQ ID NO: 16521 - DNA, 96 bp, synthetic construct
  misc_feature 1..96: note = Synthetic polypeptide
  source 1..96: mol_type = other DNA
gttactgatcagctccacgactttaggcaaaagaaggggaacgtggcccagaaacactgggttggaccttcgaatttggtcaagtgcaagccctgt

SEQ ID NO: 16522 - DNA, 2158 bp, synthetic construct; identical to SEQ ID NO: 514
  misc_feature 1..2158: note = Synthetic polypeptide
  source 1..2158: mol_type = other DNA

SEQ ID NO: 16523 - DNA, 124 bp, synthetic construct; identical to SEQ ID NO: 515
  misc_feature 1..124: note = Synthetic polypeptide
  source 1..124: mol_type = other DNA

SEQ ID NO: 16524 - DNA, 166 bp, synthetic construct; identical to SEQ ID NO: 516
  misc_feature 1..166: note = Synthetic polypeptide
  source 1..166: mol_type = other DNA

SEQ ID NO: 16525 - DNA, 1776 bp, synthetic construct; identical to SEQ ID NO: 517
  misc_feature 1..1776: note = Synthetic polypeptide
  source 1..1776: mol_type = other DNA

SEQ ID NO: 16526 - DNA, 319 bp, synthetic construct; identical to SEQ ID NO: 520
  misc_feature 1..319: note = Synthetic polypeptide
  source 1..319: mol_type = other DNA

SEQ ID NO: 16527 - DNA, 828 bp, synthetic construct; identical to SEQ ID NO: 13235
  misc_feature 1..828: note = Synthetic polypeptide
  source 1..828: mol_type = other DNA

SEQ ID NO: 16528 - DNA, 939 bp, synthetic construct; identical to SEQ ID NO: 13236
  misc_feature 1..939: note = Synthetic polypeptide
  source 1..939: mol_type = other DNA

SEQ ID NO: 16529 - DNA, 951 bp, synthetic construct; identical to SEQ ID NO: 13237
  misc_feature 1..951: note = Synthetic polypeptide
  source 1..951: mol_type = other DNA

SEQ ID NO: 16530 - DNA, 91 bp, synthetic construct; identical to SEQ ID NO: 13238
  misc_feature 1..91: note = Synthetic polypeptide
  source 1..91: mol_type = other DNA

SEQ ID NO: 16531 - DNA, 193 bp, synthetic construct
  misc_feature 1..193: note = Synthetic polypeptide
  source 1..193: mol_type = other DNA
cagaatctctgggagaatgagccagtccttgctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaa

SEQ ID NO: 16532 - DNA, 348 bp, synthetic construct
  misc_feature 1..348: note = Synthetic polypeptide
  source 1..348: mol_type = other DNA
tggtgccaggtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtga

SEQ ID NO: 16533 - DNA, 807 bp, synthetic construct; identical to SEQ ID NO: 7401
  misc_feature 1..807: note = Synthetic polypeptide
  source 1..807: mol_type = other DNA

SEQ ID NO: 16534 - DNA, 453 bp, synthetic construct; identical to SEQ ID NO: 7402
  misc_feature 1..453: note = Synthetic polypeptide
  source 1..453: mol_type = other DNA

SEQ ID NO: 16535 - DNA, 2196 bp, synthetic construct; identical to SEQ ID NO: 9550
  misc_feature 1..2196: note = Synthetic polypeptide
  source 1..2196: mol_type = other DNA

SEQ ID NO: 16536 - DNA, 1058 bp, synthetic construct
  misc_feature 1..1058: note = Synthetic polypeptide
  source 1..1058: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaggagcccctccgcccggcagccaccccgtctgggaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16537 - DNA, 1847 bp, synthetic construct
  misc_feature 1..1847: note = Synthetic polypeptide
  source 1..1847: mol_type = other DNA
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaggagcccctccgcccggcagccaccccgtctgggaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16538 - DNA, 2292 bp, synthetic construct
  misc_feature 1..2292: note = Synthetic polypeptide
  source 1..2292: mol_type = other DNA
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtga

SEQ ID NO: 16539 - DNA, 207 bp, synthetic construct
  misc_feature 1..207: note = Synthetic polypeptide
  source 1..207: mol_type = other DNA
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggatatggacaagcagcgagtgtggagggtgcctaccgactctga

SEQ ID NO: 16540 - DNA, 192 bp, synthetic construct
  misc_feature 1..192: note = Synthetic polypeptide
  source 1..192: mol_type = other DNA
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagagagcacgagcggctccgcaaataccactga

SEQ ID NO: 16541 - DNA, 309 bp, synthetic construct
  misc_feature 1..309: note = Synthetic polypeptide
  source 1..309: mol_type = other DNA
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactga

SEQ ID NO: 16542 - DNA, 4494 bp, synthetic construct
  misc_feature 1..4494: note = Synthetic polypeptide
  source 1..4494: mol_type = other DNA
tggccaataaacacatgaggagatgtccaactttactaataatcaaagaaatattaattaaaataacagtcacttttttttctttcagaatgacaagataatgaaaaatgataatcccaatattgccaagggttttgggaaaatggacacttctacaacttgtgatgagattataaattattaaaaaaacttttcagggaaacaatttggcatttaagatttgttagtggaagtcgagatggaacggcaagaatttggcagtatcagcaacaagaatggaagagtatagtgctagacatggctactaaaatgactggcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctggacatgatgatgaagtattcgttctagaagcccatccatttgatcaaaggatcatactttcagcaggtcatgatgggaacatttttatttgggaccttgaccgggggaccaaaattcggaattactttaacatgattgaaggccaaggccatggtgcggtgtttgattgtaaattttcaccagatggaaaccattttgcctgcacagattctcatggacatttgctgctttttggttttggatgcagtaaatactacgaaaagattccagatcagatgttcttccacacggattatcgtcctcttattcgtgatgccaataactatgtattggatgaacaaacccaacaagctcctcacctcatgcctcctccatttttggtggatgttgatggaaatcctcatcccacaaaattccaacggttggtaccaggacgggaaaattgtaaagatgaacagcttataccacagctgggatatgtggctaatggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttccccatttgtcccacaaatgggagatgagcttatctattttaggcaaggacatgaagcttatgttcgggctgtaaggaaatcgaaaatatacagtgttaatttacaaaaacagccatggaacaaaatggatctcagggagcaagagtttgttaagattgtaggaatcaaatatgaggttggcccacccacactgtgctgcttgaagcttgcatttctggacccaatttcaggcaaaatgactggagaatctttttccattaagtatcatgacatgccggatgtcattgacttccttgtgctacatcagttttataatgaagccaaagaaaggaactggcagattggtgatagattccgcagtataatagatgacgcctggtggtttgggactgtggagagtcagcagccttttcaaccagagtatcctgatagttctttccagtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaaaggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaa

SEQ ID NO: 16543 - DNA, 711 bp, synthetic construct
  misc_feature 1..711: note = Synthetic polypeptide
  source 1..711: mol_type = other DNA
aaaacactgataataccaactgctggcaaggatgtagagaaacaggaaggaactctcatttattactggtaggactgaaaactggcacagccactttaaaagtcagtttggcagtttcttatgaaactaaatatgttattatatgatgcagcgattgtgctccttgatattcactcaaaaaagttgaaaacttacattcacacaaaagcctgcagacaaatgttcatagcagcattattcataattgccagaacttggaagcagccattcatttcttcagtagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaa

SEQ ID NO: 16544 - DNA, 507 bp, synthetic construct
  misc_feature 1..507: note = Synthetic polypeptide
  source 1..507: mol_type = other DNA
aaaacactgataataccaactgctggcaaggatgtagagaaacaggaaggaactctcatttattactggtaggactgaaaactggcacagccactttaaaagtcagtttggcagtttcttatgaaactaaatatgttattatatgatgcagcgattgtgctccttgatattcactcaaaaaagttgaaaacttacattcacacaaaagcctgcagacaaatgttcatagcagcattattcataattgccagaacttggaagcagccattcatttcttcagtagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcagatgtgcagtaa

SEQ ID NO: 16545 - DNA, 1401 bp, synthetic construct; identical to SEQ ID NO: 7274
  misc_feature 1..1401: note = Synthetic polypeptide
  source 1..1401: mol_type = other DNA

SEQ ID NO: 16546 - DNA, 1421 bp, synthetic construct
  misc_feature 1..1421: note = Synthetic polypeptide
  source 1..1421: mol_type = other DNA
ctcacgcctctaatcctagcactttaggaggccaagtcaggaggagcgcatgagcccaggagacctgcctggacaacatagcaagactccatctctacaaaaaatggaaaaaaaaattagcaggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctatgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactga

SEQ ID NO: 16547 - DNA, 1451 bp, synthetic construct
  misc_feature 1..1451: note = Synthetic polypeptide
  source 1..1451: mol_type = other DNA
ctcacgcctctaatcctagcactttaggaggccaagtcaggaggagcgcatgagcccaggagacctgcctggacaacatagcaagactccatctctacaaaaaatggaaaaaaaaattagcaggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactga

SEQ ID NO: 16548 - DNA, 3887 bp, synthetic construct; identical to SEQ ID NO: 12657
  misc_feature 1..3887: note = Synthetic polypeptide
  source 1..3887: mol_type = other DNA

SEQ ID NO: 16549 - DNA, 3914 bp, synthetic construct; identical to SEQ ID NO: 12658
  misc_feature 1..3914: note = Synthetic polypeptide
  source 1..3914: mol_type = other DNA

SEQ ID NO: 16550 - DNA, 4010 bp, synthetic construct; identical to SEQ ID NO: 12659
  misc_feature 1..4010: note = Synthetic polypeptide
  source 1..4010: mol_type = other DNA

SEQ ID NO: 16551 - DNA, 3773 bp, synthetic construct; identical to SEQ ID NO: 12660
  misc_feature 1..3773: note = Synthetic polypeptide
  source 1..3773: mol_type = other DNA

SEQ ID NO: 16552 - DNA, 581 bp, synthetic construct; identical to SEQ ID NO: 12661
  misc_feature 1..581: note = Synthetic polypeptide
  source 1..581: mol_type = other DNA

SEQ ID NO: 16553 - DNA, 204 bp, synthetic construct; identical to SEQ ID NO: 755
  misc_feature 1..204: note = Synthetic polypeptide
  source 1..204: mol_type = other DNA

SEQ ID NO: 16554 - DNA, 459 bp, synthetic construct; identical to SEQ ID NO: 6510
  misc_feature 1..459: note = Synthetic polypeptide
  source 1..459: mol_type = other DNA

SEQ ID NO: 16555 - DNA, 504 bp, synthetic construct; identical to SEQ ID NO: 6511
  misc_feature 1..504: note = Synthetic polypeptide
  source 1..504: mol_type = other DNA

SEQ ID NO: 16556 - DNA, 516 bp, synthetic construct; identical to SEQ ID NO: 13896
  misc_feature 1..516: note = Synthetic polypeptide
  source 1..516: mol_type = other DNA

SEQ ID NO: 16557 - DNA, 446 bp, synthetic construct; identical to SEQ ID NO: 13897
  misc_feature 1..446: note = Synthetic polypeptide
  source 1..446: mol_type = other DNA

SEQ ID NO: 16558 - DNA, 5350 bp, synthetic construct; identical to SEQ ID NO: 655
  misc_feature 1..5350: note = Synthetic polypeptide
  source 1..5350: mol_type = other DNA

SEQ ID NO: 16559 - DNA, 861 bp, synthetic construct
  misc_feature 1..861: note = Synthetic polypeptide
  source 1..861: mol_type = other DNA
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaa

SEQ ID NO: 16560 - DNA, 616 bp, synthetic construct
  misc_feature 1..616: note = Synthetic polypeptide
  source 1..616: mol_type = other DNA
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccag

SEQ ID NO: 16561 - DNA, 530 bp, synthetic construct
  misc_feature 1..530: note = Synthetic polypeptide
  source 1..530: mol_type = other DNA
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaa

SEQ ID NO: 16562 - DNA, 378 bp, synthetic construct
  misc_feature 1..378: note = Synthetic polypeptide
  source 1..378: mol_type = other DNA
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaac

SEQ ID NO: 16563 - DNA, 255 bp, synthetic construct; identical to SEQ ID NO: 12596
  misc_feature 1..255: note = Synthetic polypeptide
  source 1..255: mol_type = other DNA

SEQ ID NO: 16564 - DNA, 2328 bp, synthetic construct
  misc_feature 1..2328: note = Synthetic polypeptide
  source 1..2328: mol_type = other DNA
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaa

SEQ ID NO: 16565 - DNA, 795 bp, synthetic construct
  misc_feature 1..795: note = Synthetic polypeptide
  source 1..795: mol_type = other DNA
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctacctcttggaagaaagtccttgtcctttgagactcagaaggccccacgctccagtatgccatcatga

SEQ ID NO: 16566 - DNA, 729 bp, synthetic construct
  misc_feature 1..729: note = Synthetic polypeptide
  source 1..729: mol_type = other DNA
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgtga

SEQ ID NO: 16567 - DNA, 858 bp, synthetic construct
  misc_feature 1..858: note = Synthetic polypeptide
  source 1..858: mol_type = other DNA
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggtagaaaatgttgctgtctcgggtaaaggcttctgcaagtccctcttttcctggctgtataggctacctcttggaagaaagtccttgtcctttgagactcagaaggccccacgctccagtatgccatcatga

SEQ ID NO: 16568 - DNA, 239 bp, synthetic construct
  misc_feature 1..239: note = Synthetic polypeptide
  source 1..239: mol_type = other DNA
ggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccagaggaactgtgagagtgacactgaggaggacatcgccaggaggaaagccctccacccacggaggaggagcagcacctcctaa

SEQ ID NO: 16569 - DNA, 160 bp, synthetic construct
  misc_feature 1..160: note = Synthetic polypeptide
  source 1..160: mol_type = other DNA
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagtgcttgtgactaa

SEQ ID NO: 16570 - DNA, 777 bp, synthetic construct
  misc_feature 1..777: note = Synthetic polypeptide
  source 1..777: mol_type = other DNA
cagggccaccatggatggtcgagcagtgtgtgtcccgcactaggtcctgcactggccgaggatgggggctgacgtccacccatgtgctgctggacaagccatgtgccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtag

SEQ ID NO: 16571 - DNA, 505 bp, synthetic construct
  misc_feature 1..505: note = Synthetic polypeptide
  source 1..505: mol_type = other DNA
cagggccaccatggatggtcgagcagtgtgtgtcccgcactaggtcctgcactggccgaggatgggggctgacgtccacccatgtgctgctggacaagccatgtgccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctc

SEQ ID NO: 16572 - DNA, 1629 bp, synthetic construct; identical to SEQ ID NO: 8070
  misc_feature 1..1629: note = Synthetic polypeptide
  source 1..1629: mol_type = other DNA

SEQ ID NO: 16573 - DNA, 1500 bp, synthetic construct; identical to SEQ ID NO: 8071
  misc_feature 1..1500: note = Synthetic polypeptide
  source 1..1500: mol_type = other DNA

SEQ ID NO: 16574 - DNA, 676 bp, synthetic construct; identical to SEQ ID NO: 13076
  misc_feature 1..676: note = Synthetic polypeptide
  source 1..676: mol_type = other DNA

SEQ ID NO: 16575 - DNA, 466 bp, synthetic construct; identical to SEQ ID NO: 13077
  misc_feature 1..466: note = Synthetic polypeptide
  source 1..466: mol_type = other DNA

SEQ ID NO: 16576 - DNA, 2053 bp, synthetic construct; identical to SEQ ID NO: 13078
  misc_feature 1..2053: note = Synthetic polypeptide
  source 1..2053: mol_type = other DNA

SEQ ID NO: 16577 - DNA, 2071 bp, synthetic construct; identical to SEQ ID NO: 13079
  misc_feature 1..2071: note = Synthetic polypeptide
  source 1..2071: mol_type = other DNA

SEQ ID NO: 16578 - DNA, 558 bp, synthetic construct; identical to SEQ ID NO: 13080
  misc_feature 1..558: note = Synthetic polypeptide
  source 1..558: mol_type = other DNA

SEQ ID NO: 16579 - DNA, 421 bp, synthetic construct; identical to SEQ ID NO: 13081
  misc_feature 1..421: note = Synthetic polypeptide
  source 1..421: mol_type = other DNA

SEQ ID NO: 16580 - DNA, 3871 bp, synthetic construct
  misc_feature 1..3871: note = Synthetic polypeptide
  source 1..3871: mol_type = other DNA
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16581 - DNA, 3898 bp, synthetic construct
  misc_feature 1..3898: note = Synthetic polypeptide
  source 1..3898: mol_type = other DNA
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16582 - DNA, 3994 bp, synthetic construct
  misc_feature 1..3994: note = Synthetic polypeptide
  source 1..3994: mol_type = other DNA
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16583 - DNA, 3757 bp, synthetic construct
  misc_feature 1..3757: note = Synthetic polypeptide
  source 1..3757: mol_type = other DNA
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16584 - DNA, 565 bp, synthetic construct
  misc_feature 1..565: note = Synthetic polypeptide
  source 1..565: mol_type = other DNA
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 16585 - DNA, 3125 bp, synthetic construct
  misc_feature 1..3125: note = Synthetic polypeptide
  source 1..3125: mol_type = other DNA
ggcagaattctaagatggccctccaagattcccagcctctgatgtattctcctacttattcaaacactaatctaagaattgctgtgaagagattttaggggtgtaattaatgttccaaatcattgaccttaagaaagggagatcatcctggtgggcctgacctaatcccatgagtctttaaaaactcagtgtttctctgctgatttcagaagtcagagagaagcatatgacacgttcagaagaaaggaactgccatattgtggacaaggtcacatggcagggaatggtgggcagcctctagaagctaagagcaacccccagctgacagccagcaagacatcagagacttcagtcctactgccccagaaactgaattctgccaacaacctggacgagcctggacagaaacctgagcccagagtgagaaatgcagccccagccaacacctggatttcagcctgatgagaccctgaggagagaatccagtcatgttgcatctggaattctgacctagagaactgtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtag

SEQ ID NO: 16586 - DNA, 1601 bp, synthetic construct
  misc_feature 1..1601: note = Synthetic polypeptide
  source 1..1601: mol_type = other DNA
ggcagaattctaagatggccctccaagattcccagcctctgatgtattctcctacttattcaaacactaatctaagaattgctgtgaagagattttaggggtgtaattaatgttccaaatcattgaccttaagaaagggagatcatcctggtgggcctgacctaatcccatgagtctttaaaaactcagtgtttctctgctgatttcagaagtcagagagaagcatatgacacgttcagaagaaaggaactgccatattgtggacaaggtcacatggcagggaatggtgggcagcctctagaagctaagagcaacccccagctgacagccagcaagacatcagagacttcagtcctactgccccagaaactgaattctgccaacaacctggacgagcctggacagaaacctgagcccagagtgagaaatgcagccccagccaacacctggatttcagcctgatgagaccctgaggagagaatccagtcatgttgcatctggaattctgacctagagaactgtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcagatgcagttag

SEQ ID NO: 16587 - DNA, 250 bp, synthetic construct; identical to SEQ ID NO: 6839
  misc_feature 1..250: note = Synthetic polypeptide
  source 1..250: mol_type = other DNA

SEQ ID NO: 16588 - DNA, 305 bp, synthetic construct; identical to SEQ ID NO: 6836
  misc_feature 1..305: note = Synthetic polypeptide
  source 1..305: mol_type = other DNA

SEQ ID NO: 16589 - DNA, 1426 bp, synthetic construct
  misc_feature 1..1426: note = Synthetic polypeptide
  source 1..1426: mol_type = other DNA
atagcagttaagagatgaaccctgcagcctgacttcctttgctagaatcctggcactgttacttattccttgtatgtctctaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctga

SEQ ID NO: 16590 - DNA, 425 bp, synthetic construct
  misc_feature 1..425: note = Synthetic polypeptide
  source 1..425: mol_type = other DNA
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaa

SEQ ID NO: 16591 - DNA, 1215 bp, synthetic construct
  misc_feature 1..1215: note = Synthetic polypeptide
  source 1..1215: mol_type = other DNA
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattga

SEQ ID NO: 16592 - DNA, 288 bp, synthetic construct
  misc_feature 1..288: note = Synthetic polypeptide
  source 1..288: mol_type = other DNA
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcc

SEQ ID NO: 16593 - DNA, 4061 bp, synthetic construct
  misc_feature 1..4061: note = Synthetic polypeptide
  source 1..4061: mol_type = other DNA
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16594 - DNA, 4088 bp, synthetic construct
  misc_feature 1..4088: note = Synthetic polypeptide
  source 1..4088: mol_type = other DNA
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16595 - DNA, 4184 bp, synthetic construct
  misc_feature 1..4184: note = Synthetic polypeptide
  source 1..4184: mol_type = other DNA
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16596 - DNA, 3947 bp, synthetic construct
  misc_feature 1..3947: note = Synthetic polypeptide
  source 1..3947: mol_type = other DNA
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16597 - DNA, 755 bp, synthetic construct
  misc_feature 1..755: note = Synthetic polypeptide
  source 1..755: mol_type = other DNA
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 16598 - DNA, 852 bp, synthetic construct
  misc_feature 1..852: note = Synthetic polypeptide
  source 1..852: mol_type = other DNA
gagcttggcacctcatagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctga

SEQ ID NO: 16599 - DNA, 54 bp, synthetic construct
  misc_feature 1..54: note = Synthetic polypeptide
  source 1..54: mol_type = other DNA
gagccacagcttatccagggttagatcacaaaggcaacaggtgcttgtgactaa

SEQ ID NO: 16600 - DNA, 412 bp, synthetic construct
  misc_feature 1..412: note = Synthetic polypeptide
  source 1..412: mol_type = other DNA
cttggggatgttattcaccacctcaagcatcaattttctgagtctaatataggtccaaacacccccctctggcttgttgaaaggactgaaagagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctga

SEQ ID NO: 16601 - DNA, 193 bp, synthetic construct
  misc_feature 1..193: note = Synthetic polypeptide
  source 1..193: mol_type = other DNA
cttggggatgttattcaccacctcaagcatcaattttctgagtctaatataggtccaaacacccccctctggcttgttgaaaggactgaaagagggcatcctgtacctgaaccaggaggtgcccaaggagttactggaattcctgagacttcggcacttccccacagaccccaaggctagcaactgggggtaa

SEQ ID NO: 16602 - DNA, 485 bp, synthetic construct
  misc_feature 1..485: note = Synthetic polypeptide
  source 1..485: mol_type = other DNA
agctttagcttcgtttgtagaagaagggaacagttaactgaggcattgcaaggcgtaaatgaaaatatacgtaatggacttcacacagtatccaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaa

SEQ ID NO: 16603 - DNA, 1269 bp, synthetic construct; identical to SEQ ID NO: 616
  misc_feature 1..1269: note = Synthetic polypeptide
  source 1..1269: mol_type = other DNA

SEQ ID NO: 16604 - DNA, 1134 bp, synthetic construct; identical to SEQ ID NO: 617
  misc_feature 1..1134: note = Synthetic polypeptide
  source 1..1134: mol_type = other DNA

SEQ ID NO: 16605 - DNA, 501 bp, synthetic construct; identical to SEQ ID NO: 618
  misc_feature 1..501: note = Synthetic polypeptide
  source 1..501: mol_type = other DNA

SEQ ID NO: 16606 - DNA, 1321 bp, synthetic construct; identical to SEQ ID NO: 619
  misc_feature 1..1321: note = Synthetic polypeptide
  source 1..1321: mol_type = other DNA

SEQ ID NO: 16607 - DNA, 1197 bp, synthetic construct; identical to SEQ ID NO: 620
  misc_feature 1..1197: note = Synthetic polypeptide
  source 1..1197: mol_type = other DNA

SEQ ID NO: 16608 - DNA, 1203 bp, synthetic construct; identical to SEQ ID NO: 621
  misc_feature 1..1203: note = Synthetic polypeptide
  source 1..1203: mol_type = other DNA

SEQ ID NO: 16609 - DNA, 1131 bp, synthetic construct; identical to SEQ ID NO: 622
  misc_feature 1..1131: note = Synthetic polypeptide
  source 1..1131: mol_type = other DNA

SEQ ID NO: 16610 - DNA, 642 bp, synthetic construct; identical to SEQ ID NO: 623
  misc_feature 1..642: note = Synthetic polypeptide
  source 1..642: mol_type = other DNA

SEQ ID NO: 16611 - DNA, 554 bp, synthetic construct; identical to SEQ ID NO: 12679
  misc_feature 1..554: note = Synthetic polypeptide
  source 1..554: mol_type = other DNA

SEQ ID NO: 16612 - DNA, 473 bp, synthetic construct; identical to SEQ ID NO: 12680
  misc_feature 1..473: note = Synthetic polypeptide
  source 1..473: mol_type = other DNA

SEQ ID NO: 16613 - DNA, 479 bp, synthetic construct; identical to SEQ ID NO: 12681
  misc_feature 1..479: note = Synthetic polypeptide
  source 1..479: mol_type = other DNA

SEQ ID NO: 16614 - DNA, 719 bp, synthetic construct
  misc_feature 1..719: note = Synthetic polypeptide
  source 1..719: mol_type = other DNA
gtgagaggaaggctgggctttggcgtcagaaaggccgaggtttaagtgctctccagctgcttacatgctgagtggctgtgggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctga

SEQ ID NO: 16615 - DNA, 296 bp, synthetic construct
  misc_feature 1..296: note = Synthetic polypeptide
  source 1..296: mol_type = other DNA
gtgagaggaaggctgggctttggcgtcagaaaggccgaggtttaagtgctctccagctgcttacatgctgagtggctgtgggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagggcttaa

SEQ ID NO: 16616 - DNA, 387 bp, synthetic construct; identical to SEQ ID NO: 544
  misc_feature 1..387: note = Synthetic polypeptide
  source 1..387: mol_type = other DNA

SEQ ID NO: 16617 - DNA, 540 bp, synthetic construct; identical to SEQ ID NO: 545
  misc_feature 1..540: note = Synthetic polypeptide
  source 1..540: mol_type = other DNA

SEQ ID NO: 16618 - DNA, 303 bp, synthetic construct; identical to SEQ ID NO: 547
  misc_feature 1..303: note = Synthetic polypeptide
  source 1..303: mol_type = other DNA

SEQ ID NO: 16619 - DNA, 736 bp, synthetic construct; identical to SEQ ID NO: 13712
  misc_feature 1..736: note = Synthetic polypeptide
  source 1..736: mol_type = other DNA

SEQ ID NO: 16620 - DNA, 241 bp, synthetic construct; identical to SEQ ID NO: 13713
  misc_feature 1..241: note = Synthetic polypeptide
  source 1..241: mol_type = other DNA

SEQ ID NO: 16621 - DNA, 226 bp, synthetic construct; identical to SEQ ID NO: 13714
  misc_feature 1..226: note = Synthetic polypeptide
  source 1..226: mol_type = other DNA

SEQ ID NO: 16622 - DNA, 211 bp, synthetic construct; identical to SEQ ID NO: 13715
  misc_feature 1..211: note = Synthetic polypeptide
  source 1..211: mol_type = other DNA

SEQ ID NO: 16623 - DNA, 162 bp, synthetic construct; identical to SEQ ID NO: 13716
  misc_feature 1..162: note = Synthetic polypeptide
  source 1..162: mol_type = other DNA

SEQ ID NO: 16624 - DNA, 147 bp, synthetic construct; identical to SEQ ID NO: 13717
  misc_feature 1..147: note = Synthetic polypeptide
  source 1..147: mol_type = other DNA

SEQ ID NO: 16625 - DNA, 146 bp, synthetic construct; identical to SEQ ID NO: 13718
  misc_feature 1..146: note = Synthetic polypeptide
  source 1..146: mol_type = other DNA

SEQ ID NO: 16626 - DNA, 124 bp, synthetic construct; identical to SEQ ID NO: 13719
  misc_feature 1..124: note = Synthetic polypeptide
  source 1..124: mol_type = other DNA

SEQ ID NO: 16627 - DNA, 299 bp, synthetic construct
  misc_feature 1..299: note = Synthetic polypeptide
  source 1..299: mol_type = other DNA
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactag

SEQ ID NO: 16628 - DNA, 1877 bp, synthetic construct
  misc_feature 1..1877: note = Synthetic polypeptide
  source 1..1877: mol_type = other DNA
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaaaaattttcagaagcacatgtattataacagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactga

SEQ ID NO: 16629 - DNA, 120 bp, synthetic construct
  misc_feature 1..120: note = Synthetic polypeptide
  source 1..120: mol_type = other DNA
gggagctttcagaaatcctgatgtccagactgtaccctatcccgatgaaaccagaatcgctggggtgggccccaagcaccagccatttcttcaactctccaggtcagaaagcaacattga

SEQ ID NO: 16630 - DNA, 163 bp, synthetic construct
  misc_feature 1..163: note = Synthetic polypeptide
  source 1..163: mol_type = other DNA
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaa

SEQ ID NO: 16631 - DNA, 1522 bp, synthetic construct
  misc_feature 1..1522: note = Synthetic polypeptide
  source 1..1522: mol_type = other DNA
acattcccttgctttgtcagctgagagagtctagaagcaacaacacctcactagcaatgaacacaccagtgcctggatcttggtttctaacaccgttctaggaaaggagccagggcttcttggagaattgactgattcaagggcaaaggtgggacatgcagaagataagcctggagcatctttagtagcagaaattaaggagatgcccaaaaagccaagtgatgagcacctgtcagaggcacacaggagccgggaacccaccacgggagctcgccaaggccaacctcaaagaagctgagcaggaaaagaagcaaagtcacactggagtccagcccaagcatgggctgagtatccatgagtccgtagcaatataaataaaagattgagtacataagtaatgtggaggcatgaacgagtattcccacccccctccggaacatttcccagtcactcatgactggagtccagccctagcatgggctaaatatccatgagtccatagcaatataaatacaaggatgagtacataagtaacatggaggcatgaacgagtattccatcacctcctgcctccagaacatttcccagtcactcatgactggagtccagcctgagcatgggctaaatatccatgagtctgtagcaatataaataaaagattgagtacataagtaatgtggaggcctggaggagtatcccccccaggacatttcccagtcactcatgtagctacttctcctcggaagtggagcacaacctgtacccctaagtgtgggctgtgtatggcgatgtccttccagagaggacagcatggagagggggacttcacagtggggagacctcagccagccgaccacggccaccactgtcagtgaagagtcatgtcagcagtgtgtgtacccttgttatgacatgatgagaatggcatttacctgtgtggtcttcctccccaaacccataaccccaggctatttacgaggaaaacctcagacaaatcccaactgaggagtgtcctgcaatgcacctgaccagggctcctcaaaccatcaaggtcatcaacggcaagggccatctgagaccctgtcacagccaagaggagtccaaggagatatggcagcgaaatgtgatgaggtccttggcagaaatggaaaattgggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatga

SEQ ID NO: 16632 - DNA, 294 bp, synthetic construct; identical to SEQ ID NO: 6802
  misc_feature 1..294: note = Synthetic polypeptide
  source 1..294: mol_type = other DNA

SEQ ID NO: 16633 - DNA, 737 bp, synthetic construct
  misc_feature 1..737: note = Synthetic polypeptide
  source 1..737: mol_type = other DNA
cactttgggaggctgaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatag

SEQ ID NO: 16634 - DNA, 380 bp, synthetic construct; identical to SEQ ID NO: 682
  misc_feature 1..380: note = Synthetic polypeptide
  source 1..380: mol_type = other DNA

SEQ ID NO: 16635 - DNA, 422 bp, synthetic construct; identical to SEQ ID NO: 683
  misc_feature 1..422: note = Synthetic polypeptide
  source 1..422: mol_type = other DNA

SEQ ID NO: 16636 - DNA, 271 bp, synthetic construct; identical to SEQ ID NO: 684
  misc_feature 1..271: note = Synthetic polypeptide
  source 1..271: mol_type = other DNA

SEQ ID NO: 16637 - DNA, 197 bp, synthetic construct; identical to SEQ ID NO: 685
  misc_feature 1..197: note = Synthetic polypeptide
  source 1..197: mol_type = other DNA

SEQ ID NO: 16638 - DNA, 524 bp, synthetic construct; identical to SEQ ID NO: 686
  misc_feature 1..524: note = Synthetic polypeptide
  source 1..524: mol_type = other DNA

SEQ ID NO: 16639 - DNA, 171 bp, synthetic construct
  misc_feature 1..171: note = Synthetic polypeptide
  source 1..171: mol_type = other DNA
ttctgtctccttctgccaggtgaacacacagtgttcatcccctcaggaggacacagcttttgaggtaccatcttggaagcagagaccagacctcactagacacaaacttcctggcaccttgattttggacttcatagcctctagaactttattcagaggctgctctgctga

SEQ ID NO: 16640 - DNA, 1578 bp, synthetic construct
  misc_feature 1..1578: note = Synthetic polypeptide
  source 1..1578: mol_type = other DNA
ggccgggcgtggtggctcacacctgtgatcccagcactttgggaggctgaggcgaatggatcacttgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactga

SEQ ID NO: 16641 - DNA, 1425 bp, synthetic construct
  misc_feature 1..1425: note = Synthetic polypeptide
  source 1..1425: mol_type = other DNA
ggccgggcgtggtggctcacacctgtgatcccagcactttgggaggctgaggcgaatggatcacttgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtga

SEQ ID NO: 16642 - DNA, 97 bp, synthetic construct
  misc_feature 1..97: note = Synthetic polypeptide
  source 1..97: mol_type = other DNA
ggccgggcgtggtggctcacacctgtgatcccagcactttgggaggctgaggcgaatggatcacttgaggaccaaccctcagagccccccagcccgg

SEQ ID NO: 16643 - DNA, 1259 bp, synthetic construct
  misc_feature 1..1259: note = Synthetic polypeptide
  source 1..1259: mol_type = other DNA
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttga

SEQ ID NO: 16644 - DNA, 341 bp, synthetic construct
  misc_feature 1..341: note = Synthetic polypeptide
  source 1..341: mol_type = other DNA
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctga

SEQ ID NO: 16645 - DNA, 665 bp, synthetic construct
  misc_feature 1..665: note = Synthetic polypeptide
  source 1..665: mol_type = other DNA
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaa

SEQ ID NO: 16646 - DNA, 47 bp, synthetic construct
  misc_feature 1..47: note = Synthetic polypeptide
  source 1..47: mol_type = other DNA
tgagaggtgaagccagctggacttctgggtggggattcctgagctga

SEQ ID NO: 16647 - DNA, 510 bp, synthetic construct
  misc_feature 1..510: note = Synthetic polypeptide
  source 1..510: mol_type = other DNA
gagccacagcttatccagggttagatcacaaaggcaacaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16648 - DNA, 651 bp, synthetic construct
  misc_feature 1..651: note = Synthetic polypeptide
  source 1..651: mol_type = other DNA
gagccacagcttatccagggttagatcacaaaggcaacaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16649 - DNA, 319 bp, synthetic construct; identical to SEQ ID NO: 13947
  misc_feature 1..319: note = Synthetic polypeptide
  source 1..319: mol_type = other DNA

SEQ ID NO: 16650 - DNA, 310 bp, synthetic construct; identical to SEQ ID NO: 13948
  misc_feature 1..310: note = Synthetic polypeptide
  source 1..310: mol_type = other DNA

SEQ ID NO: 16651 - DNA, 3565 bp, synthetic construct; identical to SEQ ID NO: 13949
  misc_feature 1..3565: note = Synthetic polypeptide
  source 1..3565: mol_type = other DNA

SEQ ID NO: 16652 - DNA, 3544 bp, synthetic construct; identical to SEQ ID NO: 13950
  misc_feature 1..3544: note = Synthetic polypeptide
  source 1..3544: mol_type = other DNA

SEQ ID NO: 16653 - DNA, 224 bp, synthetic construct; identical to SEQ ID NO: 13951
  misc_feature 1..224: note = Synthetic polypeptide
  source 1..224: mol_type = other DNA

SEQ ID NO: 16654 - DNA, 159 bp, synthetic construct; identical to SEQ ID NO: 13952
  misc_feature 1..159: note = Synthetic polypeptide
  source 1..159: mol_type = other DNA

SEQ ID NO: 16655 - DNA, 3508 bp, synthetic construct; identical to SEQ ID NO: 13953
  misc_feature 1..3508: note = Synthetic polypeptide
  source 1..3508: mol_type = other DNA

SEQ ID NO: 16656 - DNA, 204 bp, synthetic construct; identical to SEQ ID NO: 13957
  misc_feature 1..204: note = Synthetic polypeptide
  source 1..204: mol_type = other DNA

SEQ ID NO: 16657 - DNA, 473 bp, synthetic construct; identical to SEQ ID NO: 13576
  misc_feature 1..473: note = Synthetic polypeptide
  source 1..473: mol_type = other DNA

SEQ ID NO: 16658 - DNA, 117 bp, synthetic construct
  misc_feature 1..117: note = Synthetic polypeptide
  source 1..117: mol_type = other DNA
gagatggatctgagtcgtaatgaaatggtctccttcacagccggctgtgcgtgaactactctgtctcctgcagctcccctgtcttgataattggctgtctaggcagcgggagaatga

SEQ ID NO: 16659 - DNA, 319 bp, synthetic construct
  misc_feature 1..319: note = Synthetic polypeptide
  source 1..319: mol_type = other DNA
gagatggatctgagtcgtaatgaaatggtctccttcacagccggctgtgcgtgaactactctgtctcctgcagctcccctgtcttgataattggctgtctaggcagcgggagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctag

SEQ ID NO: 16660 - DNA, 616 bp, synthetic construct
  misc_feature 1..616: note = Synthetic polypeptide
  source 1..616: mol_type = other DNA
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16661 - DNA, 757 bp, synthetic construct
  misc_feature 1..757: note = Synthetic polypeptide
  source 1..757: mol_type = other DNA
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16662 - DNA, 2191 bp, synthetic construct
  misc_feature 1..2191: note = Synthetic polypeptide
  source 1..2191: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16663 - DNA, 2536 bp, synthetic construct
  misc_feature 1..2536: note = Synthetic polypeptide
  source 1..2536: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16664 - DNA, 1999 bp, synthetic construct
  misc_feature 1..1999: note = Synthetic polypeptide
  source 1..1999: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16665 - DNA, 2629 bp, synthetic construct
  misc_feature 1..2629: note = Synthetic polypeptide
  source 1..2629: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16666 - DNA, 2023 bp, synthetic construct
  misc_feature 1..2023: note = Synthetic polypeptide
  source 1..2023: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16667 - DNA, 2104 bp, synthetic construct
  misc_feature 1..2104: note = Synthetic polypeptide
  source 1..2104: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16668 - DNA, 1564 bp, synthetic construct
  misc_feature 1..1564: note = Synthetic polypeptide
  source 1..1564: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagtcaacgaaggcttga

SEQ ID NO: 16669 - DNA, 2461 bp, synthetic construct
  misc_feature 1..2461: note = Synthetic polypeptide
  source 1..2461: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16670 - DNA, 2266 bp, synthetic construct
  misc_feature 1..2266: note = Synthetic polypeptide
  source 1..2266: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16671 - DNA, 2359 bp, synthetic construct
  misc_feature 1..2359: note = Synthetic polypeptide
  source 1..2359: mol_type = other DNA
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16672 - DNA, 850 bp, synthetic construct
  misc_feature 1..850: note = Synthetic polypeptide
  source 1..850: mol_type = other DNA
cagttgactcttgaacaacatgggactgtaggggtccacttagagttttttctaatacattggaaaattttttggagatttgcagcaattggaaaaaactcacagatgaactgtatagcctagaaatatatttttttaattaagaagagttaggcatgtcttgaatgtgtaaaacatgtgtagatacttgtgtattttatcatttactaccacagaatatgcacaaatctattataaaaaattaaaattttatcaaaacttgcctatacaatatgcagatcatacatgaagccattcatagtcaagagaaatgtaaacaaatgtaaagatgcagtattaagtgagagtggcaaaaagttactgtggtatatactatacttctctaataatttcatagccacctcctattgctattgcagtgagttcaggtgctgcaagtatccacttaaaatgccacacattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtgatactggaagtgctcccaagaagaagagaaaagtctgacattacaagaaaaagttgaattgcttgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttga

SEQ ID NO: 16673 - DNA, 782 bp, synthetic construct
  misc_feature 1..782: note = Synthetic polypeptide
  source 1..782: mol_type = other DNA
cagttgactcttgaacaacatgggactgtaggggtccacttagagttttttctaatacattggaaaattttttggagatttgcagcaattggaaaaaactcacagatgaactgtatagcctagaaatatatttttttaattaagaagagttaggcatgtcttgaatgtgtaaaacatgtgtagatacttgtgtattttatcatttactaccacagaatatgcacaaatctattataaaaaattaaaattttatcaaaacttgcctatacaatatgcagatcatacatgaagccattcatagtcaagagaaatgtaaacaaatgtaaagatgcagtattaagtgagagtggcaaaaagttactgtggtatatactatacttctctaataatttcatagccacctcctattgctattgcagtgagttcaggtgctgcaagtatccacttaaaatgccacacattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtgatactggaagtgctcccaagaagaagagaaaagtctgacattacaagaaaaagttgaattgcttgggtttgaatgccggtgtggaaatgtttactgtggtgtacaccgttactcagatgtacacaattgctcttacaattacaaag

SEQ ID NO: 16674 - DNA, 1651 bp, synthetic construct
  misc_feature 1..1651: note = Synthetic polypeptide
  source 1..1651: mol_type = other DNA
cagaagggaagcaaagtgctgtggcaaattgtgtgctgagctgggatccaggagttctggaccttcatcttggctctgccactaattagctgtgtccttggtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttag

SEQ ID NO: 16675 - DNA, 1443 bp, synthetic construct; identical to SEQ ID NO: 6760
  misc_feature 1..1443: note = Synthetic polypeptide
  source 1..1443: mol_type = other DNA

SEQ ID NO: 16676 - DNA, 984 bp, synthetic construct; identical to SEQ ID NO: 6761
  misc_feature 1..984: note = Synthetic polypeptide
  source 1..984: mol_type = other DNA

SEQ ID NO: 16677 - DNA, 1032 bp, synthetic construct; identical to SEQ ID NO: 6762
  misc_feature 1..1032: note = Synthetic polypeptide
  source 1..1032: mol_type = other DNA

SEQ ID NO: 16678 - DNA, 1742 bp, synthetic construct
  misc_feature 1..1742: note = Synthetic polypeptide
  source 1..1742: mol_type = other DNA
gcggaagatccaggctgagagtggagacaaacaactgtggctctcattccaggctcactgtttactccgtgaccttgaccaagtctctaaatggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactga

SEQ ID NO: 16679 - DNA, 1392 bp, synthetic construct; identical to SEQ ID NO: 6782
  misc_feature 1..1392: note = Synthetic polypeptide
  source 1..1392: mol_type = other DNA

SEQ ID NO: 16680 - DNA, 933 bp, synthetic construct; identical to SEQ ID NO: 6783
  misc_feature 1..933: note = Synthetic polypeptide
  source 1..933: mol_type = other DNA

SEQ ID NO: 16681 - DNA, 981 bp, synthetic construct; identical to SEQ ID NO: 6784
  misc_feature 1..981: note = Synthetic polypeptide
  source 1..981: mol_type = other DNA

SEQ ID NO: 16682 - DNA, 846 bp, synthetic construct; identical to SEQ ID NO: 7174
  misc_feature 1..846: note = Synthetic polypeptide
  source 1..846: mol_type = other DNA

SEQ ID NO: 16683 - DNA, 506 bp, synthetic construct; identical to SEQ ID NO: 7175
  misc_feature 1..506: note = Synthetic polypeptide
  source 1..506: mol_type = other DNA

SEQ ID NO: 16684 - DNA, 672 bp, synthetic construct; identical to SEQ ID NO: 7176
  misc_feature 1..672: note = Synthetic polypeptide
  source 1..672: mol_type = other DNA

SEQ ID NO: 16685 - DNA, 708 bp, synthetic construct; identical to SEQ ID NO: 7177
  misc_feature 1..708: note = Synthetic polypeptide
  source 1..708: mol_type = other DNA

SEQ ID NO: 16686 - DNA, 298 bp, synthetic construct
  misc_feature 1..298: note = Synthetic polypeptide
  source 1..298: mol_type = other DNA
gtgtgaccgctggcctctgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcagcatggagccctagaagcttcggagctgaggacttccagctgagcagctctcttcaatcagatcaaggaccggaagaggccaccacaaaaccagcaacaacccagccacctttcctgactgcaaacctctga

SEQ ID NO: 16687 - DNA, 1410 bp, synthetic construct
  misc_feature 1..1410: note = Synthetic polypeptide
  source 1..1410: mol_type = other DNA
ggctaatagtgttggttctggagcctggaggcctaggtgcaaatactggcttcgctacttactagtggagtgaccttggacaaggggcttccctccacacttcagtttccctaataggaaactgaacatacctatgtgatggggtattgtaaagacgcaatgaatcaacattgaaagcatttagcacagtgcttggcatttggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctag

SEQ ID NO: 16688 - DNA, 362 bp, synthetic construct; identical to SEQ ID NO: 827
  misc_feature 1..362: note = Synthetic polypeptide
  source 1..362: mol_type = other DNA

SEQ ID NO: 16689 - DNA, 830 bp, synthetic construct
  misc_feature 1..830: note = Synthetic polypeptide
  source 1..830: mol_type = other DNA
atggaggatagatggctgatagaagaaaggatggataaacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16690 - DNA, 495 bp, synthetic construct; identical to SEQ ID NO: 7842
  misc_feature 1..495: note = Synthetic polypeptide
  source 1..495: mol_type = other DNA

SEQ ID NO: 16691 - DNA, 373 bp, synthetic construct; identical to SEQ ID NO: 7843
  misc_feature 1..373: note = Synthetic polypeptide
  source 1..373: mol_type = other DNA

SEQ ID NO: 16692 - DNA, 158 bp, synthetic construct
  misc_feature 1..158: note = Synthetic polypeptide
  source 1..158: mol_type = other DNA
ttccagtccatattctgccgctaactagttgtggactttgggaatacatgcaccacctgctcgccctggagcatcgcgctgaggagcagttcctggagcactggctgaaccctcactgcaaaccccactgtgacaggaacaggattcatcctgtgtaa

SEQ ID NO: 16693 - DNA, 595 bp, synthetic construct
  misc_feature 1..595: note = Synthetic polypeptide
  source 1..595: mol_type = other DNA
tgatatggtttggctgtgtcccagatctcatcttgaattcccatgtgttgtaggagagacacagtgggaggtaatggaatcacggaggcaggtctttcctgtgctgctcttgtgatagtgaataagtctcacgagatctgatggttttaaaaaggggagtttctctgcacaagctctctctttgcctgccaccatcagtgtaagatgtgacttgcttctccttgtcttctgccacgattgtgaggcctccccaaccacatggaactgtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtga

SEQ ID NO: 16694 - DNA, 525 bp, synthetic construct
  misc_feature 1..525: note = Synthetic polypeptide
  source 1..525: mol_type = other DNA
tgatatggtttggctgtgtcccagatctcatcttgaattcccatgtgttgtaggagagacacagtgggaggtaatggaatcacggaggcaggtctttcctgtgctgctcttgtgatagtgaataagtctcacgagatctgatggttttaaaaaggggagtttctctgcacaagctctctctttgcctgccaccatcagtgtaagatgtgacttgcttctccttgtcttctgccacgattgtgaggcctccccaaccacatggaactgtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaa

SEQ ID NO: 16695 - DNA, 1278 bp, synthetic construct
  misc_feature 1..1278: note = Synthetic polypeptide
  source 1..1278: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttga

SEQ ID NO: 16696 - DNA, 399 bp, synthetic construct
  misc_feature 1..399: note = Synthetic polypeptide
  source 1..399: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactgtggaacttgaattga

SEQ ID NO: 16697 - DNA, 1071 bp, synthetic construct
  misc_feature 1..1071: note = Synthetic polypeptide
  source 1..1071: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttga

SEQ ID NO: 16698 - DNA, 630 bp, synthetic construct
  misc_feature 1..630: note = Synthetic polypeptide
  source 1..630: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagtacctcactgtggaccgaaatcgtctatggtatgtgccgcgccatctctgccagctgcccagcctcaatga

SEQ ID NO: 16699 - DNA, 1113 bp, synthetic construct
  misc_feature 1..1113: note = Synthetic polypeptide
  source 1..1113: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctga

SEQ ID NO: 16700 - DNA, 1211 bp, synthetic construct
  misc_feature 1..1211: note = Synthetic polypeptide
  source 1..1211: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagac

SEQ ID NO: 16701 - DNA, 456 bp, synthetic construct
  misc_feature 1..456: note = Synthetic polypeptide
  source 1..456: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactgaagacaactgttagttttgtggcttactgctgctccacccagtgtctgcagacttttgacctgctgagttga

SEQ ID NO: 16702 - DNA, 684 bp, synthetic construct
  misc_feature 1..684: note = Synthetic polypeptide
  source 1..684: mol_type = other DNA
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatgg

SEQ ID NO: 16703 - DNA, 527 bp, synthetic construct
  misc_feature 1..527: note = Synthetic polypeptide
  source 1..527: mol_type = other DNA
ggctgggctctgtggctcatgcctgtaatcccagcactttgggaggccaaggcaggaggatctcttgacaggagcccaaggtcaggagttcaagcttgaccaatgaggtggtccatatgtgtcccaccattggcagcaacgtggaggagatcattctgccgaagacccacttcttcatgtgggacatagtgagacctgaggctctgagctttatctggaacacatactactccaacactgagtttatcatccttgtgattgacagcacggaccgggatcggctgctgaccactcgggaggagctatataaaatgctggcccatgaggctctacaggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggctgcctgccagacttcagtggatggaatctcaggccgctgctaactga

SEQ ID NO: 16704 - DNA, 1075 bp, synthetic construct
  misc_feature 1..1075: note = Synthetic polypeptide
  source 1..1075: mol_type = other DNA
gtgagcgagtaggggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctga

SEQ ID NO: 16705 - DNA, 205 bp, synthetic construct
  misc_feature 1..205: note = Synthetic polypeptide
  source 1..205: mol_type = other DNA
gtgagcgagtaggggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtga

SEQ ID NO: 16706 - DNA, 803 bp, synthetic construct
  misc_feature 1..803: note = Synthetic polypeptide
  source 1..803: mol_type = other DNA
catatgtgtgtagagaaaagactggaggaatagacaacaaaacatgaacagtgcttggccctttaaaaaagccttggatggaaattcttattttcttctctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaa

SEQ ID NO: 16707 - DNA, 497 bp, synthetic construct
  misc_feature 1..497: note = Synthetic polypeptide
  source 1..497: mol_type = other DNA
ctcaaactgtgacccatgaaccagtaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattga

SEQ ID NO: 16708 - DNA, 386 bp, synthetic construct
  misc_feature 1..386: note = Synthetic polypeptide
  source 1..386: mol_type = other DNA
atctggtttctggctatatctcctgtattatttttcagcagtattccccttgaactttaagttattaccatggtgaactgctgtatttcgtgaacaagccttgttccctgtcaccttggggaatttgcaaatacttttccggatgcctggaacacaggtcccactacctaccttccatctgtgctgctttgcctggctaactgctgcttaccacccagatctgcttagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataa

SEQ ID NO: 16709 - DNA, 309 bp, synthetic construct; identical to SEQ ID NO: 7876
  misc_feature 1..309: note = Synthetic polypeptide
  source 1..309: mol_type = other DNA

SEQ ID NO: 16710 - DNA, 699 bp, synthetic construct
  misc_feature 1..699: note = Synthetic polypeptide
  source 1..699: mol_type = other DNA
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctga

SEQ ID NO: 16711 - DNA, 367 bp, synthetic construct
  misc_feature 1..367: note = Synthetic polypeptide
  source 1..367: mol_type = other DNA
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcacctgtgagaatcccagatgtcctttctcccagctcccagcactgccctcccagctag

SEQ ID NO: 16712 - DNA, 311 bp, synthetic construct
  misc_feature 1..311: note = Synthetic polypeptide
  source 1..311: mol_type = other DNA
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcac

SEQ ID NO: 16713 - DNA, 772 bp, synthetic construct
  misc_feature 1..772: note = Synthetic polypeptide
  source 1..772: mol_type = other DNA
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16714 - DNA, 602 bp, synthetic construct
  misc_feature 1..602: note = Synthetic polypeptide
  source 1..602: mol_type = other DNA
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctga

SEQ ID NO: 16715 - DNA, 721 bp, synthetic construct
  misc_feature 1..721: note = Synthetic polypeptide
  source 1..721: mol_type = other DNA
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaacaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16716 - DNA, 748 bp, synthetic construct
  misc_feature 1..748: note = Synthetic polypeptide
  source 1..748: mol_type = other DNA
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16717 - DNA, 80 bp, synthetic construct; identical to SEQ ID NO: 6364
  misc_feature 1..80: note = Synthetic polypeptide
  source 1..80: mol_type = other DNA

SEQ ID NO: 16718 - DNA, 217 bp, synthetic construct; identical to SEQ ID NO: 6365
  misc_feature 1..217: note = Synthetic polypeptide
  source 1..217: mol_type = other DNA

SEQ ID NO: 16719 - DNA, 1721 bp, synthetic construct
  misc_feature 1..1721: note = Synthetic polypeptide
  source 1..1721: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 16720 - DNA, 1835 bp, synthetic construct
  misc_feature 1..1835: note = Synthetic polypeptide
  source 1..1835: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 16721 - DNA, 253 bp, synthetic construct
  misc_feature 1..253: note = Synthetic polypeptide
  source 1..253: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggca

SEQ ID NO: 16722 - DNA, 319 bp, synthetic construct
  misc_feature 1..319: note = Synthetic polypeptide
  source 1..319: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaa

SEQ ID NO: 16723 - DNA, 231 bp, synthetic construct
  misc_feature 1..231: note = Synthetic polypeptide
  source 1..231: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtg

SEQ ID NO: 16724 - DNA, 338 bp, synthetic construct
  misc_feature 1..338: note = Synthetic polypeptide
  source 1..338: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagacttggtcattgtccctcagatgcctccagagcacacggtgcaggggtgtcacctttccgacgtacccatgggtgcccggagttgcctccttagtgggatcaagaccatcccccacatgtcatggacagctggtgacctggtcgctcttggtgtttga

SEQ ID NO: 16725 - DNA, 598 bp, synthetic construct
  misc_feature 1..598: note = Synthetic polypeptide
  source 1..598: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggctt

SEQ ID NO: 16726 - DNA, 156 bp, synthetic construct
  misc_feature 1..156: note = Synthetic polypeptide
  source 1..156: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgg

SEQ ID NO: 16727 - DNA, 520 bp, synthetic construct
  misc_feature 1..520: note = Synthetic polypeptide
  source 1..520: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagca

SEQ ID NO: 16728 - DNA, 318 bp, synthetic construct
  misc_feature 1..318: note = Synthetic polypeptide
  source 1..318: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatga

SEQ ID NO: 16729 - DNA, 561 bp, synthetic construct
  misc_feature 1..561: note = Synthetic polypeptide
  source 1..561: mol_type = other DNA
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccg

SEQ ID NO: 16730 - DNA, 337 bp, synthetic construct; identical to SEQ ID NO: 6393
  misc_feature 1..337: note = Synthetic polypeptide
  source 1..337: mol_type = other DNA

SEQ ID NO: 16731 - DNA, 2333 bp, synthetic construct; identical to SEQ ID NO: 7950
  misc_feature 1..2333: note = Synthetic polypeptide
  source 1..2333: mol_type = other DNA

SEQ ID NO: 16732 - DNA, 1267 bp, synthetic construct; identical to SEQ ID NO: 463
  misc_feature 1..1267: note = Synthetic polypeptide
  source 1..1267: mol_type = other DNA

SEQ ID NO: 16733 - DNA, 665 bp, synthetic construct; identical to SEQ ID NO: 6374
  misc_feature 1..665: note = Synthetic polypeptide
  source 1..665: mol_type = other DNA

SEQ ID NO: 16734 - DNA, 518 bp, synthetic construct; identical to SEQ ID NO: 6375
  misc_feature 1..518: note = Synthetic polypeptide
  source 1..518: mol_type = other DNA

SEQ ID NO: 16735 - DNA, 1057 bp, synthetic construct
  misc_feature 1..1057: note = Synthetic polypeptide
  source 1..1057: mol_type = other DNA
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16736 - DNA, 1066 bp, synthetic construct
  misc_feature 1..1066: note = Synthetic polypeptide
  source 1..1066: mol_type = other DNA
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16737 - DNA, 1087 bp, synthetic construct
  misc_feature 1..1087: note = Synthetic polypeptide
  source 1..1087: mol_type = other DNA
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16738 - DNA, 169 bp, synthetic construct
  misc_feature 1..169: note = Synthetic polypeptide
  source 1..169: mol_type = other DNA
ggccgggcgcggtggctcatgcctgtaatcccagcactttgggaggcagaggcgggcggattcccagggccaagaccagcttcaagtctccatggtaccagaaaacaacaacctcacagcacctgaacctcaagaagaggtatccacaagtgaaaatccacaactctga

SEQ ID NO: 16739 - DNA, 742 bp, synthetic construct; identical to SEQ ID NO: 6357
  misc_feature 1..742: note = Synthetic polypeptide
  source 1..742: mol_type = other DNA

SEQ ID NO: 16740 - DNA, 590 bp, synthetic construct; identical to SEQ ID NO: 6358
  misc_feature 1..590: note = Synthetic polypeptide
  source 1..590: mol_type = other DNA

SEQ ID NO: 16741 - DNA, 577 bp, synthetic construct; identical to SEQ ID NO: 6359
  misc_feature 1..577: note = Synthetic polypeptide
  source 1..577: mol_type = other DNA

SEQ ID NO: 16742 - DNA, 430 bp, synthetic construct; identical to SEQ ID NO: 6360
  misc_feature 1..430: note = Synthetic polypeptide
  source 1..430: mol_type = other DNA

SEQ ID NO: 16743 - DNA, 670 bp, synthetic construct; identical to SEQ ID NO: 6361
  misc_feature 1..670: note = Synthetic polypeptide
  source 1..670: mol_type = other DNA

SEQ ID NO: 16744 - DNA, 712 bp, synthetic construct
  misc_feature 1..712: note = Synthetic polypeptide
  source 1..712: mol_type = other DNA
atggaggatagatggctgatagaagaaaggatggataaacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16745 - DNA, 1350 bp, synthetic construct
  misc_feature 1..1350: note = Synthetic polypeptide
  source 1..1350: mol_type = other DNA
cttagcataaaaatacataatttgcttctttgggtcttgatttctgaaggctccaatgtcacgtaaaactttggttagatgaatttgtgttgcttttctcttgttactctctctcttgttctaggggtatcagccatgacctctgcaatgggtgaggaaaagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacccaaaggaaagactaagacatctcgagatctggcgtgttttatacagtttgaaaatgtcaacatttactatgggactcagcataaaatgaaatataaagcgcccactgactattgctttgttttaaagcacccccaaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgccccctccggtgcggaggtcctccgacaccagcggcagtcccgccacgcccctcaaggccaagggcacaggcggcgggggcttgcccgccccacccgacgacttcctgccgccgccgccaccgccgccgcccctcgatgaccctgagctcccgccgccgcccccggacttcatggagccgcccccagacttcgtgcccccgcccccgccgtcgtacgcagggatcgcgggctcagagctgcccccgccgccgccgccgccgcccgcgcccgcgcccgcccccgtccccgactccgccaggccgccccccgcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctag

SEQ ID NO: 16746 - DNA, 243 bp, synthetic construct; identical to SEQ ID NO: 6494
  misc_feature 1..243: note = Synthetic polypeptide
  source 1..243: mol_type = other DNA

SEQ ID NO: 16747 - DNA, 369 bp, synthetic construct; identical to SEQ ID NO: 6492
  misc_feature 1..369: note = Synthetic polypeptide
  source 1..369: mol_type = other DNA

SEQ ID NO: 16748 - DNA, 1232 bp, synthetic construct; identical to SEQ ID NO: 6566
  misc_feature 1..1232: note = Synthetic polypeptide
  source 1..1232: mol_type = other DNA

SEQ ID NO: 16749 - DNA, 497 bp, synthetic construct; identical to SEQ ID NO: 6567
  misc_feature 1..497: note = Synthetic polypeptide
  source 1..497: mol_type = other DNA

SEQ ID NO: 16750 - DNA, 575 bp, synthetic construct; identical to SEQ ID NO: 6568
  misc_feature 1..575: note = Synthetic polypeptide
  source 1..575: mol_type = other DNA

SEQ ID NO: 16751 - DNA, 1926 bp, synthetic construct; identical to SEQ ID NO: 7679
  misc_feature 1..1926: note = Synthetic polypeptide
  source 1..1926: mol_type = other DNA

SEQ ID NO: 16752 - DNA, 477 bp, synthetic construct; identical to SEQ ID NO: 7680
  misc_feature 1..477: note = Synthetic polypeptide
  source 1..477: mol_type = other DNA

SEQ ID NO: 16753 - DNA, 711 bp, synthetic construct; identical to SEQ ID NO: 7681
  misc_feature 1..711: note = Synthetic polypeptide
  source 1..711: mol_type = other DNA

SEQ ID NO: 16754 - DNA, 288 bp, synthetic construct; identical to SEQ ID NO: 7682
  misc_feature 1..288: note = Synthetic polypeptide
  source 1..288: mol_type = other DNA

SEQ ID NO: 16755 - DNA, 237 bp, synthetic construct; identical to SEQ ID NO: 7683
  misc_feature 1..237: note = Synthetic polypeptide
  source 1..237: mol_type = other DNA

SEQ ID NO: 16756 - DNA, 703 bp, synthetic construct; identical to SEQ ID NO: 7684
  misc_feature 1..703: note = Synthetic polypeptide
  source 1..703: mol_type = other DNA

SEQ ID NO: 16757 - DNA, 330 bp, synthetic construct; identical to SEQ ID NO: 6490
  misc_feature 1..330: note = Synthetic polypeptide
  source 1..330: mol_type = other DNA

SEQ ID NO: 16758 - DNA, 355 bp, synthetic construct
  misc_feature 1..355: note = Synthetic polypeptide
  source 1..355: mol_type = other DNA
gctgggcgcggtggctcatgcctgtcatcccagcattttgggaggccgaggtgggcgaatcacctgaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 16759 - DNA, 637 bp, synthetic construct
  misc_feature 1..637: note = Synthetic polypeptide
  source 1..637: mol_type = other DNA
cagagtggacaggcagaggcccggcttctcattcctgctcacaactaactcactgcagcactcaggacaactcagctaagctgtctggaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctggtcctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctga

SEQ ID NO: 16760 - DNA, 334 bp, synthetic construct
  misc_feature 1..334: note = Synthetic polypeptide
  source 1..334: mol_type = other DNA
cagagtggacaggcagaggcccggcttctcattcctgctcacaactaactcactgcagcactcaggacaactcagctaagctgtctggaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctgaaaaagacctcgctctgggactcctgcagacagcagtggctcagctccttccccagcccctag

SEQ ID NO: 16761 - DNA, 158 bp, synthetic construct; identical to SEQ ID NO: 7602
  misc_feature 1..158: note = Synthetic polypeptide
  source 1..158: mol_type = other DNA

SEQ ID NO: 16762 - DNA, 1047 bp, synthetic construct; identical to SEQ ID NO: 8738
  misc_feature 1..1047: note = Synthetic polypeptide
  source 1..1047: mol_type = other DNA

SEQ ID NO: 16763 - DNA, 1883 bp, synthetic construct; identical to SEQ ID NO: 6345
  misc_feature 1..1883: note = Synthetic polypeptide
  source 1..1883: mol_type = other DNA

SEQ ID NO: 16764 - DNA, 348 bp, synthetic construct
  misc_feature 1..348: note = Synthetic polypeptide
  source 1..348: mol_type = other DNA
tggtgtcagagtaggatttgaaagagaccccctgtggcctctggaagcatcgaggaaccaggcaaaaggtgtccattgtgctcactgctttctcgctgcatctggaggtcctgggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16765 - DNA, 1848 bp, synthetic construct; identical to SEQ ID NO: 7940
  misc_feature 1..1848: note = Synthetic polypeptide
  source 1..1848: mol_type = other DNA

SEQ ID NO: 16766 - DNA, 1767 bp, synthetic construct; identical to SEQ ID NO: 7857
  misc_feature 1..1767: note = Synthetic polypeptide
  source 1..1767: mol_type = other DNA

SEQ ID NO: 16767 - DNA, 1764 bp, synthetic construct; identical to SEQ ID NO: 7858
  misc_feature 1..1764: note = Synthetic polypeptide
  source 1..1764: mol_type = other DNA

SEQ ID NO: 16768 - DNA, 630 bp, synthetic construct; identical to SEQ ID NO: 7859
  misc_feature 1..630: note = Synthetic polypeptide
  source 1..630: mol_type = other DNA

SEQ ID NO: 16769 - DNA, 396 bp, synthetic construct
  misc_feature 1..396: note = Synthetic polypeptide
  source 1..396: mol_type = other DNA
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacaactaagattacatccactggagaaatgttccagaatggactactga

SEQ ID NO: 16770 - DNA, 462 bp, synthetic construct
  misc_feature 1..462: note = Synthetic polypeptide
  source 1..462: mol_type = other DNA
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacatag

SEQ ID NO: 16771 - DNA, 363 bp, synthetic construct
  misc_feature 1..363: note = Synthetic polypeptide
  source 1..363: mol_type = other DNA
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacaattttacaaatga

SEQ ID NO: 16772 - DNA, 148 bp, synthetic construct; identical to SEQ ID NO: 6388
  misc_feature 1..148: note = Synthetic polypeptide
  source 1..148: mol_type = other DNA

SEQ ID NO: 16773 - DNA, 1100 bp, synthetic construct; identical to SEQ ID NO: 6389
  misc_feature 1..1100: note = Synthetic polypeptide
  source 1..1100: mol_type = other DNA

SEQ ID NO: 16774 - DNA, 464 bp, synthetic construct; identical to SEQ ID NO: 6390
  misc_feature 1..464: note = Synthetic polypeptide
  source 1..464: mol_type = other DNA

SEQ ID NO: 16775 - DNA, 280 bp, synthetic construct; identical to SEQ ID NO: 6391
  misc_feature 1..280: note = Synthetic polypeptide
  source 1..280: mol_type = other DNA

SEQ ID NO: 16776 - DNA, 387 bp, synthetic construct
  misc_feature 1..387: note = Synthetic polypeptide
  source 1..387: mol_type = other DNA
ggccgggcgcggtggcttactcctgtaatcccagcactttgggaagctgaggtgggcgaatcacgaggtcaggagatggagaccatcctgactaacatgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattga

SEQ ID NO: 16777 - DNA, 238 bp, synthetic construct; identical to SEQ ID NO: 6378
  misc_feature 1..238: note = Synthetic polypeptide
  source 1..238: mol_type = other DNA

SEQ ID NO: 16778 - DNA, 337 bp, synthetic construct
  misc_feature 1..337: note = Synthetic polypeptide
  source 1..337: mol_type = other DNA
gctgggcgcggtggctcatgcctgtcatcccagcattttgggaggccgaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 16779 - DNA, 812 bp, synthetic construct
  misc_feature 1..812: note = Synthetic polypeptide
  source 1..812: mol_type = other DNA
atagacaagtggatggaaggagaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16780 - DNA, 441 bp, synthetic construct
  misc_feature 1..441: note = Synthetic polypeptide
  source 1..441: mol_type = other DNA
gaagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 16781 - DNA, 438 bp, synthetic construct
  misc_feature 1..438: note = Synthetic polypeptide
  source 1..438: mol_type = other DNA
gaagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 16782 - DNA, 443 bp, synthetic construct
  misc_feature 1..443: note = Synthetic polypeptide
  source 1..443: mol_type = other DNA
ctcagataagccatgccacctctcctgacctctgtgtcctcatggggaaagtggggctaacaggaaaatgccctttgctgcatgtccaggggattaaggaaatgggatccctccaagcaggtgcctgcagcccagtgggcgcttaataactgatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatga

SEQ ID NO: 16783 - DNA, 1033 bp, synthetic construct; identical to SEQ ID NO: 7576
  misc_feature 1..1033: note = Synthetic polypeptide
  source 1..1033: mol_type = other DNA

SEQ ID NO: 16784 - DNA, 1048 bp, synthetic construct; identical to SEQ ID NO: 7577
  misc_feature 1..1048: note = Synthetic polypeptide
  source 1..1048: mol_type = other DNA

SEQ ID NO: 16785 - DNA, 892 bp, synthetic construct
  misc_feature 1..892: note = Synthetic polypeptide
  source 1..892: mol_type = other DNA
tataacatatgtagcacactaaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctga

SEQ ID NO: 16786 - DNA, 1627 bp, synthetic construct
  misc_feature 1..1627: note = Synthetic polypeptide
  source 1..1627: mol_type = other DNA
gaggggctcagggctgagtccttggacctcttctttcttttcagcattcactcttggcggtctgattttatagctttagacactatctggtgatgactgtcacatttttgtactagcctggacttctcctggaactcaagactggcatatccaggagcgggggcgttgacgctccctggaggtctagtactcatctcaggcagaacgcgttcaaacagactcaggattttctgccccctcttcttcccaaagccttccccacctgagtaaatggaacctctgttccagccttctgggttctctcaattcacgaatctgggagtcatctcctcccctccctttcctccccactcccaactccctttactccaacaactcatccctctgcaaatcctgtcagtgcagccttcagagtagacccaggatgtgacaacttctcatcatctccactgctactgtcatatttcttgtctggagtcttctccaacagtctctgcagttgtccccttgcttccaccctttcccttccacacagcactggagtgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactga

SEQ ID NO: 16787 - DNA, 1272 bp, synthetic construct; identical to SEQ ID NO: 10519
  misc_feature 1..1272: note = Synthetic polypeptide
  source 1..1272: mol_type = other DNA

SEQ ID NO: 16788 - DNA, 694 bp, synthetic construct
  misc_feature 1..694: note = Synthetic polypeptide
  source 1..694: mol_type = other DNA
atagacaagtggatggaaggagagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16789 - DNA, 1729 bp, synthetic construct
  misc_feature 1..1729: note = Synthetic polypeptide
  source 1..1729: mol_type = other DNA
ttatctccctcaaatcttttttcagaaagctactggagggtgcattgtactaaggaagagagagactgatgactgaggaaggattggaacgcagggagcaggatatccgtcactgggggagaagcagctgaagatgatgcctgtgcccgggcagatggtgctcagtcctcagagcaggaagtggtgccgagaaagtctccccaaagacgagattgccaggcagcccgatgccgggtgagcatggacatctccagaggagatttgaacagtttaaagagccagggtggaatgagcgataaacagacagctaagcaagtgaaaaaccccttctcctgttagcttgaggggaagcacaaagtaggaaggagttggaagtcaccatggtttcctttgtggcctcagtgtgagtggttgagcacccagctgtgctcagctagacgcggggctcagccagacgcggggcagctagagctgtggtgatggtggtacctgcggggcggcagaggggtggtgggagcacagagccatggcctcctcttccatcctgagaagtcacaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtag

SEQ ID NO: 16790 - DNA, 857 bp, synthetic construct; identical to SEQ ID NO: 8024
  misc_feature 1..857: note = Synthetic polypeptide
  source 1..857: mol_type = other DNA

SEQ ID NO: 16791 - DNA, 729 bp, synthetic construct
  misc_feature 1..729: note = Synthetic polypeptide
  source 1..729: mol_type = other DNA
gttgatcagtggtaaatatgaaaagaactgggttttctagctgactacagatttaatatcatctagcaacctatgtggctgttaacatagctgttctgtctttggatggtttaaaatcatctgactcccacaccacagagaagaatcattcttgccttcctctccagtcaacagctcacagccatggactgcaggacactccgccttgagaacactttaaaatggccattgcccatctgtaatggcttccgtgccaccaaggtgatgaggaatcccaaaactgtgacagagaagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 16792 - DNA, 67 bp, synthetic construct; identical to SEQ ID NO: 16124
  misc_feature 1..67: note = Synthetic polypeptide
  source 1..67: mol_type = other DNA

SEQ ID NO: 16793 - DNA, 871 bp, synthetic construct; identical to SEQ ID NO: 437
  misc_feature 1..871: note = Synthetic polypeptide
  source 1..871: mol_type = other DNA

SEQ ID NO: 16794 - DNA, 421 bp, synthetic construct; identical to SEQ ID NO: 441
  misc_feature 1..421: note = Synthetic polypeptide
  source 1..421: mol_type = other DNA

SEQ ID NO: 16795 - DNA, 638 bp, synthetic construct; identical to SEQ ID NO: 442
  misc_feature 1..638: note = Synthetic polypeptide
  source 1..638: mol_type = other DNA

SEQ ID NO: 16796 - DNA, 337 bp, synthetic construct; identical to SEQ ID NO: 443
  misc_feature 1..337: note = Synthetic polypeptide
  source 1..337: mol_type = other DNA

SEQ ID NO: 16797 - DNA, 3021 bp, synthetic construct; identical to SEQ ID NO: 449
  misc_feature 1..3021: note = Synthetic polypeptide
  source 1..3021: mol_type = other DNA

SEQ ID NO: 16798 - DNA, 3075 bp, synthetic construct; identical to SEQ ID NO: 450
  misc_feature 1..3075: note = Synthetic polypeptide
  source 1..3075: mol_type = other DNA

SEQ ID NO: 16799 - DNA, 1143 bp, synthetic construct; identical to SEQ ID NO: 451
  misc_feature 1..1143: note = Synthetic polypeptide
  source 1..1143: mol_type = other DNA

SEQ ID NO: 16800 - DNA, 179 bp, synthetic construct
  misc_feature 1..179: note = Synthetic polypeptide
  source 1..179: mol_type = other DNA
gctgagtgtggtggtgcatctgtaattccagctacttgagaggccgaggtgggaggatcgcttgagcccgggagttccagtctgcagtgagctatgtcttgccccagaagctgcgggcacatccacgcctgaaatgcggcgctcagtcctggtcaggaacccaggccacaaaggcctga

SEQ ID NO: 16801 - DNA, 913 bp, synthetic construct
  misc_feature 1..913: note = Synthetic polypeptide
  source 1..913: mol_type = other DNA
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaa

SEQ ID NO: 16802 - DNA, 355 bp, synthetic construct
  misc_feature 1..355: note = Synthetic polypeptide
  source 1..355: mol_type = other DNA
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctc

SEQ ID NO: 16803 - DNA, 215 bp, synthetic construct
  misc_feature 1..215: note = Synthetic polypeptide
  source 1..215: mol_type = other DNA
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttga

SEQ ID NO: 16804 - DNA, 102 bp, synthetic construct
  misc_feature 1..102: note = Synthetic polypeptide
  source 1..102: mol_type = other DNA
gcttctttctcattttctcttgctgccgccatgtaagaagtgcctttcacctcctgccatgattttgaggcctccccagccatgtggaactatgcgacctaa

SEQ ID NO: 16805 - DNA, 1061 bp, synthetic construct
  misc_feature 1..1061: note = Synthetic polypeptide
  source 1..1061: mol_type = other DNA
cagcaggtcctcaaataatgccattttgttcaacattgttttgttatcatgttgatgaggaaaaaaagaaatcacttcctggctgggaccactgaccacgtggagtttgcacattctgcccatgtctgcacgggttttccctgggtactccagtttcctctcacctcccagagagccgcgcattagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttga

SEQ ID NO: 16806 - DNA, 896 bp, synthetic construct
  misc_feature 1..896: note = Synthetic polypeptide
  source 1..896: mol_type = other DNA
cagcaggtcctcaaataatgccattttgttcaacattgttttgttatcatgttgatgaggaaaaaaagaaatcacttcctggctgggaccactgaccacgtggagtttgcacattctgcccatgtctgcacgggttttccctgggtactccagtttcctctcacctcccagagagccgcgcattagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatggcagcacaaagacagaaaaggggcaagtga

SEQ ID NO: 16807 - DNA, 118 bp, synthetic construct; identical to SEQ ID NO: 7912
  misc_feature 1..118: note = Synthetic polypeptide
  source 1..118: mol_type = other DNA

SEQ ID NO: 16808 - DNA, 435 bp, synthetic construct; identical to SEQ ID NO: 7913
  misc_feature 1..435: note = Synthetic polypeptide
  source 1..435: mol_type = other DNA

SEQ ID NO: 16809 - DNA, 519 bp, synthetic construct; identical to SEQ ID NO: 7914
  misc_feature 1..519: note = Synthetic polypeptide
  source 1..519: mol_type = other DNA

SEQ ID NO: 16810 - DNA, 480 bp, synthetic construct; identical to SEQ ID NO: 7915
  misc_feature 1..480: note = Synthetic polypeptide
  source 1..480: mol_type = other DNA

SEQ ID NO: 16811 - DNA, 597 bp, synthetic construct; identical to SEQ ID NO: 7916
  misc_feature 1..597: note = Synthetic polypeptide
  source 1..597: mol_type = other DNA

SEQ ID NO: 16812 - DNA, 440 bp, synthetic construct
  misc_feature 1..440: note = Synthetic polypeptide
  source 1..440: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 16813 - DNA, 778 bp, synthetic construct
  misc_feature 1..778: note = Synthetic polypeptide
  source 1..778: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 16814 - DNA, 408 bp, synthetic construct
  misc_feature 1..408: note = Synthetic polypeptide
  source 1..408: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctga

SEQ ID NO: 16815 - DNA, 597 bp, synthetic construct
  misc_feature 1..597: note = Synthetic polypeptide
  source 1..597: mol_type = other DNA
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactga

SEQ ID NO: 16816 - DNA, 750 bp, synthetic construct
  misc_feature 1..750: note = Synthetic polypeptide
  source 1..750: mol_type = other DNA
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacggaagaatacaaagaagcctcagaggggctcagcctgagaaaacctggctctcaggaagaactttgcaagagcagccgtggaggacagagtgctcttgggcccccatggcccaaatgcagagttacccccactgccctgtggagaaccgggaagatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactga

SEQ ID NO: 16817 - DNA, 543 bp, synthetic construct
  misc_feature 1..543: note = Synthetic polypeptide
  source 1..543: mol_type = other DNA
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaaggtag

SEQ ID NO: 16818 - DNA, 213 bp, synthetic construct
  misc_feature 1..213: note = Synthetic polypeptide
  source 1..213: mol_type = other DNA
aaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggaagaagagtttacaacagatgaagcagatgaaactaggagcaatgaaacccagaatcctcataaaccatc

SEQ ID NO: 16819 - DNA, 400 bp, synthetic construct
  misc_feature 1..400: note = Synthetic polypeptide
  source 1..400: mol_type = other DNA
aaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaa

SEQ ID NO: 16820 - DNA, 629 bp, synthetic construct; identical to SEQ ID NO: 7943
  misc_feature 1..629: note = Synthetic polypeptide
  source 1..629: mol_type = other DNA

SEQ ID NO: 16821 - DNA, 472 bp, synthetic construct; identical to SEQ ID NO: 7944
  misc_feature 1..472: note = Synthetic polypeptide
  source 1..472: mol_type = other DNA

SEQ ID NO: 16822 - DNA, 1227 bp, synthetic construct; identical to SEQ ID NO: 7622
  misc_feature 1..1227: note = Synthetic polypeptide
  source 1..1227: mol_type = other DNA

SEQ ID NO: 16823 - DNA, 362 bp, synthetic construct
  misc_feature 1..362: note = Synthetic polypeptide
  source 1..362: mol_type = other DNA
gtcagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattga

SEQ ID NO: 16824 - DNA, 543 bp, synthetic construct; identical to SEQ ID NO: 6496
  misc_feature 1..543: note = Synthetic polypeptide
  source 1..543: mol_type = other DNA

SEQ ID NO: 16825 - DNA, 378 bp, synthetic construct; identical to SEQ ID NO: 6497
  misc_feature 1..378: note = Synthetic polypeptide
  source 1..378: mol_type = other DNA

SEQ ID NO: 16826 - DNA, 267 bp, synthetic construct; identical to SEQ ID NO: 6498
  misc_feature 1..267: note = Synthetic polypeptide
  source 1..267: mol_type = other DNA

SEQ ID NO: 16827 - DNA, 416 bp, synthetic construct; identical to SEQ ID NO: 6499
  misc_feature 1..416: note = Synthetic polypeptide
  source 1..416: mol_type = other DNA

SEQ ID NO: 16828 - DNA, 162 bp, synthetic construct; identical to SEQ ID NO: 6500
  misc_feature 1..162: note = Synthetic polypeptide
  source 1..162: mol_type = other DNA

SEQ ID NO: 16829 - DNA, 405 bp, synthetic construct; identical to SEQ ID NO: 7860
  misc_feature 1..405: note = Synthetic polypeptide
  source 1..405: mol_type = other DNA

SEQ ID NO: 16830 - DNA, 274 bp, synthetic construct; identical to SEQ ID NO: 7861
  misc_feature 1..274: note = Synthetic polypeptide
  source 1..274: mol_type = other DNA

SEQ ID NO: 16831 - DNA, 196 bp, synthetic construct; identical to SEQ ID NO: 7862
  misc_feature 1..196: note = Synthetic polypeptide
  source 1..196: mol_type = other DNA

SEQ ID NO: 16832 - DNA, 268 bp, synthetic construct; identical to SEQ ID NO: 7863
  misc_feature 1..268: note = Synthetic polypeptide
  source 1..268: mol_type = other DNA

SEQ ID NO: 16833 - DNA, 186 bp, synthetic construct; identical to SEQ ID NO: 7864
  misc_feature 1..186: note = Synthetic polypeptide
  source 1..186: mol_type = other DNA

SEQ ID NO: 16834 - DNA, 204 bp, synthetic construct; identical to SEQ ID NO: 7897
  misc_feature 1..204: note = Synthetic polypeptide
  source 1..204: mol_type = other DNA

SEQ ID NO: 16835 - DNA, 287 bp, synthetic construct; identical to SEQ ID NO: 7993
  misc_feature 1..287: note = Synthetic polypeptide
  source 1..287: mol_type = other DNA

SEQ ID NO: 16836 - DNA, 914 bp, synthetic construct; identical to SEQ ID NO: 7994
  misc_feature 1..914: note = Synthetic polypeptide
  source 1..914: mol_type = other DNA

SEQ ID NO: 16837 - DNA, 674 bp, synthetic construct; identical to SEQ ID NO: 7995
  misc_feature 1..674: note = Synthetic polypeptide
  source 1..674: mol_type = other DNA

SEQ ID NO: 16838 - DNA, 308 bp, synthetic construct; identical to SEQ ID NO: 7996
  misc_feature 1..308: note = Synthetic polypeptide
  source 1..308: mol_type = other DNA

SEQ ID NO: 16839 - DNA, 175 bp, synthetic construct; identical to SEQ ID NO: 7997
  misc_feature 1..175: note = Synthetic polypeptide
  source 1..175: mol_type = other DNA

SEQ ID NO: 16840 - DNA, 777 bp, synthetic construct; identical to SEQ ID NO: 16570
  misc_feature 1..777: note = Synthetic polypeptide
  source 1..777: mol_type = other DNA

SEQ ID NO: 16841 - DNA, 505 bp, synthetic construct; identical to SEQ ID NO: 16571
  misc_feature 1..505: note = Synthetic polypeptide
  source 1..505: mol_type = other DNA

SEQ ID NO: 16842 - DNA, 187 bp, synthetic construct; identical to SEQ ID NO: 7942
  misc_feature 1..187: note = Synthetic polypeptide
  source 1..187: mol_type = other DNA

SEQ ID NO: 16843 - DNA, 294 bp, synthetic construct; identical to SEQ ID NO: 7554
  misc_feature 1..294: note = Synthetic polypeptide
  source 1..294: mol_type = other DNA

SEQ ID NO: 16844 - DNA, 208 bp, synthetic construct; identical to SEQ ID NO: 7555
  misc_feature 1..208: note = Synthetic polypeptide
  source 1..208: mol_type = other DNA

SEQ ID NO: 16845 - DNA, 147 bp, synthetic construct; identical to SEQ ID NO: 6327
  misc_feature 1..147: note = Synthetic polypeptide
  source 1..147: mol_type = other DNA

SEQ ID NO: 16846 - DNA, 589 bp, synthetic construct; identical to SEQ ID NO: 16101
  misc_feature 1..589: note = Synthetic polypeptide
  source 1..589: mol_type = other DNA

SEQ ID NO: 16847 - DNA, 848 bp, synthetic construct; identical to SEQ ID NO: 7921
  misc_feature 1..848: note = Synthetic polypeptide
  source 1..848: mol_type = other DNA

SEQ ID NO: 16848 - DNA, 230 bp, synthetic construct; identical to SEQ ID NO: 7922
  misc_feature 1..230: note = Synthetic polypeptide
  source 1..230: mol_type = other DNA

SEQ ID NO: 16849 - DNA, 476 bp, synthetic construct
  misc_feature 1..476: note = Synthetic polypeptide
  source 1..476: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 16850 - DNA, 814 bp, synthetic construct
  misc_feature 1..814: note = Synthetic polypeptide
  source 1..814: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 16851 - DNA, 444 bp, synthetic construct
  misc_feature 1..444: note = Synthetic polypeptide
  source 1..444: mol_type = other DNA
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctga

SEQ ID NO: 16852 - DNA, 557 bp, synthetic construct; identical to SEQ ID NO: 6591
  misc_feature 1..557: note = Synthetic polypeptide
  source 1..557: mol_type = other DNA

SEQ ID NO: 16853 - DNA, 191 bp, synthetic construct
  misc_feature 1..191: note = Synthetic polypeptide
  source 1..191: mol_type = other DNA
atagtattgcacagtgacgaagagtgctgactttggggtcagactgggtttgaatctccctgtttactaactgggaatacatgcaccacctgctcgccctggagcatcgcgctgaggagcagttcctggagcactggctgaaccctcactgcaaaccccactgtgacaggaacaggattcatcctgtgtaa

SEQ ID NO: 16854 - DNA, 1516 bp, synthetic construct; identical to SEQ ID NO: 534
  misc_feature 1..1516: note = Synthetic polypeptide
  source 1..1516: mol_type = other DNA

SEQ ID NO: 16855 - DNA, 591 bp, synthetic construct; identical to SEQ ID NO: 539
  misc_feature 1..591: note = Synthetic polypeptide
  source 1..591: mol_type = other DNA

SEQ ID NO: 16856 - DNA, 482 bp, synthetic construct; identical to SEQ ID NO: 540
  misc_feature 1..482: note = Synthetic polypeptide
  source 1..482: mol_type = other DNA

SEQ ID NO: 16857 - DNA, 444 bp, synthetic construct; identical to SEQ ID NO: 541
  misc_feature 1..444: note = Synthetic polypeptide
  source 1..444: mol_type = other DNA

SEQ ID NO: 16858 - DNA, 334 bp, synthetic construct; identical to SEQ ID NO: 533
  misc_feature 1..334: note = Synthetic polypeptide
  source 1..334: mol_type = other DNA

SEQ ID NO: 16859 - DNA, 38 bp, synthetic construct; identical to SEQ ID NO: 543
  misc_feature 1..38: note = Synthetic polypeptide
  source 1..38: mol_type = other DNA

SEQ ID NO: 16860 - DNA, 245 bp, synthetic construct; identical to SEQ ID NO: 542
  misc_feature 1..245: note = Synthetic polypeptide
  source 1..245: mol_type = other DNA

SEQ ID NO: 16861 - DNA, 513 bp, synthetic construct
  misc_feature 1..513: note = Synthetic polypeptide
  source 1..513: mol_type = other DNA
ggccgggcacggtggctcacgtctgtaatcccagcactttgggaggctgagacgggaggatcccctgaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctga

SEQ ID NO: 16862 - DNA, 426 bp, synthetic construct
  misc_feature 1..426: note = Synthetic polypeptide
  source 1..426: mol_type = other DNA
ggccgggcacggtggctcacgtctgtaatcccagcactttgggaggctgagacgggaggatcccctgaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagag

SEQ ID NO: 16863 - DNA, 2825 bp, synthetic construct; identical to SEQ ID NO: 6727
  misc_feature 1..2825: note = Synthetic polypeptide
  source 1..2825: mol_type = other DNA

SEQ ID NO: 16864 - DNA, 987 bp, synthetic construct
  misc_feature 1..987: note = Synthetic polypeptide
  source 1..987: mol_type = other DNA
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactga

SEQ ID NO: 16865 - DNA, 826 bp, synthetic construct
  misc_feature 1..826: note = Synthetic polypeptide
  source 1..826: mol_type = other DNA
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccc

SEQ ID NO: 16866 - DNA, 509 bp, synthetic construct
  misc_feature 1..509: note = Synthetic polypeptide
  source 1..509: mol_type = other DNA
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagg

SEQ ID NO: 16867 - DNA, 582 bp, synthetic construct
  misc_feature 1..582: note = Synthetic polypeptide
  source 1..582: mol_type = other DNA
tggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactga

SEQ ID NO: 16868 - DNA, 196 bp, synthetic construct
  misc_feature 1..196: note = Synthetic polypeptide
  source 1..196: mol_type = other DNA
tggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctga

SEQ ID NO: 16869 - DNA, 1280 bp, synthetic construct
  misc_feature 1..1280: note = Synthetic polypeptide
  source 1..1280: mol_type = other DNA
cctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtgctctcttttctgctgtggcctgtgtgaatagcctggccatgctgacggcctccggcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctga

SEQ ID NO: 16870 - DNA, 1367 bp, synthetic construct
  misc_feature 1..1367: note = Synthetic polypeptide
  source 1..1367: mol_type = other DNA
cctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcattttcaactcactctacccagccactctgaactttatgaaggggttccccttcctcctgggagctggcctcctgctcatcccggctgttctgattgggatgctggaaaaggctgatcctcacctcgagttccagcagtttccccagagcccctga

SEQ ID NO: 16871 - DNA, 437 bp, synthetic construct
  misc_feature 1..437: note = Synthetic polypeptide
  source 1..437: mol_type = other DNA
ggccaggcgcggtggctcttgcctgtaatctcagcactttggatgccaaggcgggtggatcacttgaggtcaggagttcaagaccagccagcacaacatgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtga

SEQ ID NO: 16872 - DNA, 180 bp, synthetic construct
  misc_feature 1..180: note = Synthetic polypeptide
  source 1..180: mol_type = other DNA
ggccaggcgcggtggctcttgcctgtaatctcagcactttggatgccaaggcgggtggatcacttgaggtcaggagttcaagaccagccagcacaacatgctgtgagaccaaagacctggttgtgcaacaggcaggcacaaacaagactgatgttgtctgtggtccccaggatcggctga

SEQ ID NO: 16873 - DNA, 2483 bp, synthetic construct
  misc_feature 1..2483: note = Synthetic polypeptide
  source 1..2483: mol_type = other DNA
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactga

SEQ ID NO: 16874 - DNA, 704 bp, synthetic construct
  misc_feature 1..704: note = Synthetic polypeptide
  source 1..704: mol_type = other DNA
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctga

SEQ ID NO: 16875 - DNA, 407 bp, synthetic construct
  misc_feature 1..407: note = Synthetic polypeptide
  source 1..407: mol_type = other DNA
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacattga

SEQ ID NO: 16876 - DNA, 645 bp, synthetic construct
  misc_feature 1..645: note = Synthetic polypeptide
  source 1..645: mol_type = other DNA
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccag

SEQ ID NO: 16877 - DNA, 227 bp, synthetic construct
  misc_feature 1..227: note = Synthetic polypeptide
  source 1..227: mol_type = other DNA
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagtttcagcgtga

SEQ ID NO: 16878 - DNA, 1273 bp, synthetic construct; identical to SEQ ID NO: 6700
  misc_feature 1..1273: note = Synthetic polypeptide
  source 1..1273: mol_type = other DNA

SEQ ID NO: 16879 - DNA, 1357 bp, synthetic construct; identical to SEQ ID NO: 6701
  misc_feature 1..1357: note = Synthetic polypeptide
  source 1..1357: mol_type = other DNA

SEQ ID NO: 16880 - DNA, 1546 bp, synthetic construct; identical to SEQ ID NO: 6702
  misc_feature 1..1546: note = Synthetic polypeptide
  source 1..1546: mol_type = other DNA

SEQ ID NO: 16881 - DNA, 1621 bp, synthetic construct; identical to SEQ ID NO: 6703
  misc_feature 1..1621: note = Synthetic polypeptide
  source 1..1621: mol_type = other DNA

SEQ ID NO: 16882 - DNA, 1282 bp, synthetic construct; identical to SEQ ID NO: 6704
  misc_feature 1..1282: note = Synthetic polypeptide
  source 1..1282: mol_type = other DNA

SEQ ID NO: 16883 - DNA, 1639 bp, synthetic construct; identical to SEQ ID NO: 6705
  misc_feature 1..1639: note = Synthetic polypeptide
  source 1..1639: mol_type = other DNA

SEQ ID NO: 16884 - DNA, 614 bp, synthetic construct; identical to SEQ ID NO: 10761
  misc_feature 1..614: note = Synthetic polypeptide
  source 1..614: mol_type = other DNA

SEQ ID NO: 16885 - DNA, 50 bp, synthetic construct; identical to SEQ ID NO: 10762
  misc_feature 1..50: note = Synthetic polypeptide
  source 1..50: mol_type = other DNA

SEQ ID NO: 16886 - DNA, 209 bp, synthetic construct; identical to SEQ ID NO: 10763
  misc_feature 1..209: note = Synthetic polypeptide
  source 1..209: mol_type = other DNA

SEQ ID NO: 16887 - DNA, 617 bp, synthetic construct; identical to SEQ ID NO: 10764
  misc_feature 1..617: note = Synthetic polypeptide
  source 1..617: mol_type = other DNA

SEQ ID NO: 16888 - DNA, 771 bp, synthetic construct
  misc_feature 1..771: note = Synthetic polypeptide
  source 1..771: mol_type = other DNA
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagatgcactcaactgtcctctcttctgctcttcctcctacaaactgggcaactggaatcagaacagagactttggatgagcatccagtgtaa

SEQ ID NO: 16889 - DNA, 546 bp, synthetic construct
  misc_feature 1..546: note = Synthetic polypeptide
  source 1..546: mol_type = other DNA
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatag

SEQ ID NO: 16890 - DNA, 648 bp, synthetic construct
  misc_feature 1..648: note = Synthetic polypeptide
  source 1..648: mol_type = other DNA
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagagacaacattttgctctgtcacccaagctgaactgaactgggctccagaaatcctcccacctcagcctcctgagcagctaggactacagatgtgccaccatacccagctaattttttaa

SEQ ID NO: 16891 - DNA, 594 bp, synthetic construct
  misc_feature 1..594: note = Synthetic polypeptide
  source 1..594: mol_type = other DNA
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagaattttggcacatttgcatatctggtttctcaatccagaacagactaaaagaaaatgagtcctga

SEQ ID NO: 16892 - DNA, 675 bp, synthetic construct
  misc_feature 1..675: note = Synthetic polypeptide
  source 1..675: mol_type = other DNA
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctga

SEQ ID NO: 16893 - DNA, 375 bp, synthetic construct
  misc_feature 1..375: note = Synthetic polypeptide
  source 1..375: mol_type = other DNA
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgaggctcaaaaatga

SEQ ID NO: 16894 - DNA, 603 bp, synthetic construct
  misc_feature 1..603: note = Synthetic polypeptide
  source 1..603: mol_type = other DNA
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctga

SEQ ID NO: 16895 - DNA, 241 bp, synthetic construct
  misc_feature 1..241: note = Synthetic polypeptide
  source 1..241: mol_type = other DNA
ggggaggagccaagatggccgaataggaacagctccggtctacagctcccagcgtgagcgacgcagaagacgggtgatttctgcatttccatctgaggtaccgggttcatctcactagggagtgccagacagtgggcgcaggccaaggcggtgggaccgaagttacctctggagtatgaaaataagcaacaccattatgaaaagtcaaaagaactttggagtcaaacagtcctgcatttga

SEQ ID NO: 16896 - DNA, 509 bp, synthetic construct
  misc_feature 1..509: note = Synthetic polypeptide
  source 1..509: mol_type = other DNA
atggaggatagatggctgatagaagaaaggatggataaacaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16897 - DNA, 1520 bp, synthetic construct
  misc_feature 1..1520: note = Synthetic polypeptide
  source 1..1520: mol_type = other DNA
gccgggcgcggtggctcacacctgtaatcccagcactttgggaggacaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaggagaaatatgctgtatttaaaaacccccagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacccaaaggaaagactaagacatctcgagatctggcgtgttttatacagtttgaaaatgtcaacatttactatgggactcagcataaaatgaaatataaagcgcccactgactattgctttgttttaaagcacccccaaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgccccctccggtgcggaggtcctccgacaccagcggcagtcccgccacgcccctcaaggccaagggcacaggcggcgggggcttgcccgccccacccgacgacttcctgccgccgccgccaccgccgccgcccctcgatgaccctgagctcccgccgccgcccccggacttcatggagccgcccccagacttcgtgcccccgcccccgccgtcgtacgcagggatcgcgggctcagagctgcccccgccgccgccgccgccgcccgcgcccgcgcccgcccccgtccccgactccgccaggccgccccccgcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctag

SEQ ID NO: 16898 - DNA, 1206 bp, synthetic construct; identical to SEQ ID NO: 7670
  misc_feature 1..1206: note = Synthetic polypeptide
  source 1..1206: mol_type = other DNA

SEQ ID NO: 16899 - DNA, 1134 bp, synthetic construct; identical to SEQ ID NO: 7671
  misc_feature 1..1134: note = Synthetic polypeptide
  source 1..1134: mol_type = other DNA

SEQ ID NO: 16900 - DNA, 1002 bp, synthetic construct; identical to SEQ ID NO: 7672
  misc_feature 1..1002: note = Synthetic polypeptide
  source 1..1002: mol_type = other DNA

SEQ ID NO: 16901 - DNA, 1036 bp, synthetic construct; identical to SEQ ID NO: 754
  misc_feature 1..1036: note = Synthetic polypeptide
  source 1..1036: mol_type = other DNA

SEQ ID NO: 16902 - DNA, 338 bp, synthetic construct; identical to SEQ ID NO: 6370
  misc_feature 1..338: note = Synthetic polypeptide
  source 1..338: mol_type = other DNA

SEQ ID NO: 16903 - DNA, 242 bp, synthetic construct; identical to SEQ ID NO: 6371
  misc_feature 1..242: note = Synthetic polypeptide
  source 1..242: mol_type = other DNA

SEQ ID NO: 16904 - DNA, 451 bp, synthetic construct
  misc_feature 1..451: note = Synthetic polypeptide
  source 1..451: mol_type = other DNA
ggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttag

SEQ ID NO: 16905 - DNA, 665 bp, synthetic construct
  misc_feature 1..665: note = Synthetic polypeptide
  source 1..665: mol_type = other DNA
ggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctag

SEQ ID NO: 16906 - DNA, 135 bp, synthetic construct
  misc_feature 1..135: note = Synthetic polypeptide
  source 1..135: mol_type = other DNA
agcgtcacgttatggaaagagcagagcccaggaatgaggccacccagtctcccaggtggaaaacgaagctcattcccaacgtgcaaagccaaggcagcgaccccaggacctcttctggagatggaagcttgttga

SEQ ID NO: 16907 - DNA, 463 bp, synthetic construct; identical to SEQ ID NO: 803
  misc_feature 1..463: note = Synthetic polypeptide
  source 1..463: mol_type = other DNA

SEQ ID NO: 16908 - DNA, 289 bp, synthetic construct
  misc_feature 1..289: note = Synthetic polypeptide
  source 1..289: mol_type = other DNA
aaaatcaaggattagccaggcctggtaatgtattcctgtaatcctagctcagtgctgcggtgggaagattgctggagcccaggagttcgaggctgcgtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctga

SEQ ID NO: 16909 - DNA, 334 bp, synthetic construct
  misc_feature 1..334: note = Synthetic polypeptide
  source 1..334: mol_type = other DNA
aaaatcaaggattagccaggcctggtaatgtattcctgtaatcctagctcagtgctgcggtgggaagattgctggagcccaggagttcgaggctgcgtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtggaaaacgaagctcattcccaacgtgcaaagccaaggcagcgaccccaggacctcttctggagatggaagcttgttga

SEQ ID NO: 16910 - DNA, 6087 bp, synthetic construct
  misc_feature 1..6087: note = Synthetic polypeptide
  source 1..6087: mol_type = other DNA
gaggaggaggaggaggaggaggaggaggaggaggaggaggaggacgacgacgagggagtactcgggcgcgggccgggccacgaccggggccgcgaccgccacagcccccccggctgccacctcttcccgccgccgccgccgccgccgccaccgctgcccccgccgccgccgcccccgccgccagataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactga

SEQ ID NO: 16911 - DNA, 148 bp, synthetic construct
  misc_feature 1..148: note = Synthetic polypeptide
  source 1..148: mol_type = other DNA
ggccaggcgcagtgactcacacctgtcatcccagcactttgagaggctgtgatccaggcagatcacggggttaggagttcaagaccagcctggccaatatggtcctgtcggcggcaagcgagcagcctgcgcaggtggctggagctga

SEQ ID NO: 16912 - DNA, 318 bp, synthetic construct
  misc_feature 1..318: note = Synthetic polypeptide
  source 1..318: mol_type = other DNA
ggccaggcgcagtgactcacacctgtcatcccagcactttgagaggctgtgatccaggcagatcacggggttaggagttcaagaccagcctggccaatatggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctag

SEQ ID NO: 16913 - DNA, 703 bp, synthetic construct
  misc_feature 1..703: note = Synthetic polypeptide
  source 1..703: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagatgggatccctgcctgtaccatcctgagcccttaa

SEQ ID NO: 16914 - DNA, 748 bp, synthetic construct
  misc_feature 1..748: note = Synthetic polypeptide
  source 1..748: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttga

SEQ ID NO: 16915 - DNA, 691 bp, synthetic construct
  misc_feature 1..691: note = Synthetic polypeptide
  source 1..691: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagataactctcttcactattcctag

SEQ ID NO: 16916 - DNA, 748 bp, synthetic construct
  misc_feature 1..748: note = Synthetic polypeptide
  source 1..748: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctag

SEQ ID NO: 16917 - DNA, 1039 bp, synthetic construct
  misc_feature 1..1039: note = Synthetic polypeptide
  source 1..1039: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctag

SEQ ID NO: 16918 - DNA, 306 bp, synthetic construct
  misc_feature 1..306: note = Synthetic polypeptide
  source 1..306: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcc

SEQ ID NO: 16919 - DNA, 441 bp, synthetic construct
  misc_feature 1..441: note = Synthetic polypeptide
  source 1..441: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgcccccctcagggaagcaggagctgcagcccttcgaccgcaacct

SEQ ID NO: 16920 - DNA, 380 bp, synthetic construct
  misc_feature 1..380: note = Synthetic polypeptide
  source 1..380: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaagg

SEQ ID NO: 16921 - DNA, 398 bp, synthetic construct
  misc_feature 1..398: note = Synthetic polypeptide
  source 1..398: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgc

SEQ ID NO: 16922 - DNA, 745 bp, synthetic construct
  misc_feature 1..745: note = Synthetic polypeptide
  source 1..745: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataa

SEQ ID NO: 16923 - DNA, 188 bp, synthetic construct
  misc_feature 1..188: note = Synthetic polypeptide
  source 1..188: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctga

SEQ ID NO: 16924 - DNA, 172 bp, synthetic construct
  misc_feature 1..172: note = Synthetic polypeptide
  source 1..172: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaaggtacaagcctgggatggggaggggcccagtga

SEQ ID NO: 16925 - DNA, 442 bp, synthetic construct
  misc_feature 1..442: note = Synthetic polypeptide
  source 1..442: mol_type = other DNA
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatg

SEQ ID NO: 16926 - DNA, 811 bp, synthetic construct
  misc_feature 1..811: note = Synthetic polypeptide
  source 1..811: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16927 - DNA, 754 bp, synthetic construct
  misc_feature 1..754: note = Synthetic polypeptide
  source 1..754: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16928 - DNA, 376 bp, synthetic construct
  misc_feature 1..376: note = Synthetic polypeptide
  source 1..376: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggttcttctagctcctcttcttcctcctcgtcctcctcctcttcctccagtgatggccggaagaagcgggggaagtacaaggacaagaggaggaagaagaagaagaagaggaagaagctga

SEQ ID NO: 16929 - DNA, 650 bp, synthetic construct
  misc_feature 1..650: note = Synthetic polypeptide
  source 1..650: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcacca

SEQ ID NO: 16930 - DNA, 745 bp, synthetic construct
  misc_feature 1..745: note = Synthetic polypeptide
  source 1..745: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtga

SEQ ID NO: 16931 - DNA, 787 bp, synthetic construct
  misc_feature 1..787: note = Synthetic polypeptide
  source 1..787: mol_type = other DNA
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16932 - DNA, 261 bp, synthetic construct
  misc_feature 1..261: note = Synthetic polypeptide
  source 1..261: mol_type = other DNA
atcccgacttctccccccagctctgtgccttcgggccttggcttccccactctgggcctgtttcctggtctgtgaaatgggaactcaccccggtgttgttggaagcacccagctcagtgcctggcacaggactcggtgaaatacctggagtgctcagctctcacccagagaggcctgaaaaccgtgttcgacgaggccatccgggccgtgctgtgccctcagcccacgcggcagcagaagcgcgcctgcagcctcctctag

SEQ ID NO: 16933 - DNA, 181 bp, synthetic construct
  misc_feature 1..181: note = Synthetic polypeptide
  source 1..181: mol_type = other DNA
atcccgacttctccccccagctctgtgccttcgggccttggcttccccactctgggcctgtttcctggtctgtgaaatgggaactcaccccggtgttgttggaagcacccagctcagtgcctggcacaggactcggtgaaatacctggagtgctcagctctcacccagagaggcctgaaaa

SEQ ID NO: 16934 - DNA, 1463 bp, synthetic construct
  misc_feature 1..1463: note = Synthetic polypeptide
  source 1..1463: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16935 - DNA, 1460 bp, synthetic construct
  misc_feature 1..1460: note = Synthetic polypeptide
  source 1..1460: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16936 - DNA, 1415 bp, synthetic construct
  misc_feature 1..1415: note = Synthetic polypeptide
  source 1..1415: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16937 - DNA, 1047 bp, synthetic construct
  misc_feature 1..1047: note = Synthetic polypeptide
  source 1..1047: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatcc

SEQ ID NO: 16938 - DNA, 963 bp, synthetic construct
  misc_feature 1..963: note = Synthetic polypeptide
  source 1..963: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaa

SEQ ID NO: 16939 - DNA, 570 bp, synthetic construct
  misc_feature 1..570: note = Synthetic polypeptide
  source 1..570: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgt

SEQ ID NO: 16940 - DNA, 440 bp, synthetic construct
  misc_feature 1..440: note = Synthetic polypeptide
  source 1..440: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgg

SEQ ID NO: 16941 - DNA, 384 bp, synthetic construct
  misc_feature 1..384: note = Synthetic polypeptide
  source 1..384: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatgg

SEQ ID NO: 16942 - DNA, 376 bp, synthetic construct
  misc_feature 1..376: note = Synthetic polypeptide
  source 1..376: mol_type = other DNA
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcacc

SEQ ID NO: 16943 - DNA, 456 bp, synthetic construct
  misc_feature 1..456: note = Synthetic polypeptide
  source 1..456: mol_type = other DNA
ggctttggaaccagctggatctaggctgtgccacatactacctctttggccttggccacatccctaaactcttggattctgtttcctaagatgtaagatggagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctga

SEQ ID NO: 16944 - DNA, 137 bp, synthetic construct
  misc_feature 1..137: note = Synthetic polypeptide
  source 1..137: mol_type = other DNA
ggctttggaaccagctggatctaggctgtgccacatactacctctttggccttggccacatccctaaactcttggattctgtttcctaagatgtaagatggagagaatcctttcctgtttgcattggaagccgtggt

SEQ ID NO: 16945 - DNA, 562 bp, synthetic construct
  misc_feature 1..562: note = Synthetic polypeptide
  source 1..562: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaa

SEQ ID NO: 16946 - DNA, 387 bp, synthetic construct
  misc_feature 1..387: note = Synthetic polypeptide
  source 1..387: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgca

SEQ ID NO: 16947 - DNA, 382 bp, synthetic construct
  misc_feature 1..382: note = Synthetic polypeptide
  source 1..382: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgac

SEQ ID NO: 16948 - DNA, 367 bp, synthetic construct
  misc_feature 1..367: note = Synthetic polypeptide
  source 1..367: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacagg

SEQ ID NO: 16949 - DNA, 356 bp, synthetic construct
  misc_feature 1..356: note = Synthetic polypeptide
  source 1..356: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggagg

SEQ ID NO: 16950 - DNA, 236 bp, synthetic construct
  misc_feature 1..236: note = Synthetic polypeptide
  source 1..236: mol_type = other DNA
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagc

SEQ ID NO: 16951 - DNA, 355 bp, synthetic construct
  misc_feature 1..355: note = Synthetic polypeptide
  source 1..355: mol_type = other DNA
tataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgttggaggaactgcagatgtttacctgggagaagagtgaaaggatgggagggaagaggaaactctgatgaggaagaaagtgcttcagaatctgaactttggaagggtccactaccagagacagatgaaaaatcacaggaagaagaatttgatgagtattttcaggatttgtttctatga

SEQ ID NO: 16952 - DNA, 2087 bp, synthetic construct; identical to SEQ ID NO: 9707
  misc_feature 1..2087: note = Synthetic polypeptide
  source 1..2087: mol_type = other DNA

SEQ ID NO: 16953 - DNA, 581 bp, synthetic construct; identical to SEQ ID NO: 9708
  misc_feature 1..581: note = Synthetic polypeptide
  source 1..581: mol_type = other DNA

SEQ ID NO: 16954 - DNA, 769 bp, synthetic construct; identical to SEQ ID NO: 6486
  misc_feature 1..769: note = Synthetic polypeptide
  source 1..769: mol_type = other DNA

SEQ ID NO: 16955 - DNA, 1516 bp, synthetic construct; identical to SEQ ID NO: 534
  misc_feature 1..1516: note = Synthetic polypeptide
  source 1..1516: mol_type = other DNA

SEQ ID NO: 16956 - DNA, 591 bp, synthetic construct; identical to SEQ ID NO: 539
  misc_feature 1..591: note = Synthetic polypeptide
  source 1..591: mol_type = other DNA

SEQ ID NO: 16957 - DNA, 482 bp, synthetic construct; identical to SEQ ID NO: 540
  misc_feature 1..482: note = Synthetic polypeptide
  source 1..482: mol_type = other DNA

SEQ ID NO: 16958 - DNA, 444 bp, synthetic construct; identical to SEQ ID NO: 541
  misc_feature 1..444: note = Synthetic polypeptide
  source 1..444: mol_type = other DNA

SEQ ID NO: 16959 - DNA, 334 bp, synthetic construct; identical to SEQ ID NO: 533
  misc_feature 1..334: note = Synthetic polypeptide
  source 1..334: mol_type = other DNA

SEQ ID NO: 16960 - DNA, 38 bp, synthetic construct; identical to SEQ ID NO: 543
  misc_feature 1..38: note = Synthetic polypeptide
  source 1..38: mol_type = other DNA

SEQ ID NO: 16961 - DNA, 245 bp, synthetic construct; identical to SEQ ID NO: 542
  misc_feature 1..245: note = Synthetic polypeptide
  source 1..245: mol_type = other DNA

SEQ ID NO: 16962 - DNA, 742 bp, synthetic construct; identical to SEQ ID NO: 6357
  misc_feature 1..742: note = Synthetic polypeptide
  source 1..742: mol_type = other DNA

SEQ ID NO: 16963 - DNA, 590 bp, synthetic construct; identical to SEQ ID NO: 6358
  misc_feature 1..590: note = Synthetic polypeptide
  source 1..590: mol_type = other DNA

SEQ ID NO: 16964 - DNA, 577 bp, synthetic construct; identical to SEQ ID NO: 6359
  misc_feature 1..577: note = Synthetic polypeptide
  source 1..577: mol_type = other DNA

SEQ ID NO: 16965 - DNA, 430 bp, synthetic construct; identical to SEQ ID NO: 6360
  misc_feature 1..430: note = Synthetic polypeptide
  source 1..430: mol_type = other DNA

SEQ ID NO: 16966 - DNA, 670 bp, synthetic construct; identical to SEQ ID NO: 6361
  misc_feature 1..670: note = Synthetic polypeptide
  source 1..670: mol_type = other DNA

SEQ ID NO: 16967 - DNA, 2016 bp, synthetic construct; identical to SEQ ID NO: 9715
  misc_feature 1..2016: note = Synthetic polypeptide
  source 1..2016: mol_type = other DNA

SEQ ID NO: 16968 - DNA, 510 bp, synthetic construct; identical to SEQ ID NO: 9716
  misc_feature 1..510: note = Synthetic polypeptide
  source 1..510: mol_type = other DNA

SEQ ID NO: 16969 - DNA, 163 bp, synthetic construct; identical to SEQ ID NO: 480
  misc_feature 1..163: note = Synthetic polypeptide
  source 1..163: mol_type = other DNA

SEQ ID NO: 16970 - DNA, 104 bp, synthetic construct; identical to SEQ ID NO: 481
  misc_feature 1..104: note = Synthetic polypeptide
  source 1..104: mol_type = other DNA

SEQ ID NO: 16971 - DNA, 330 bp, synthetic construct; identical to SEQ ID NO: 6490
  misc_feature 1..330: note = Synthetic polypeptide
  source 1..330: mol_type = other DNA

SEQ ID NO: 16972 - DNA, 2484 bp, synthetic construct; identical to SEQ ID NO: 9884
  misc_feature 1..2484: note = Synthetic polypeptide
  source 1..2484: mol_type = other DNA

SEQ ID NO: 16973 - DNA, 871 bp, synthetic construct; identical to SEQ ID NO: 437
  misc_feature 1..871: note = Synthetic polypeptide
  source 1..871: mol_type = other DNA

SEQ ID NO: 16974 - DNA, 421 bp, synthetic construct; identical to SEQ ID NO: 441
  misc_feature 1..421: note = Synthetic polypeptide
  source 1..421: mol_type = other DNA

SEQ ID NO: 16975 - DNA, 638 bp, synthetic construct; identical to SEQ ID NO: 442
  misc_feature 1..638: note = Synthetic polypeptide
  source 1..638: mol_type = other DNA

SEQ ID NO: 16976 - DNA, 337 bp, synthetic construct; identical to SEQ ID NO: 443
  misc_feature 1..337: note = Synthetic polypeptide
  source 1..337: mol_type = other DNA

SEQ ID NO: 16977 - DNA, 80 bp, synthetic construct; identical to SEQ ID NO: 6364
  misc_feature 1..80: note = Synthetic polypeptide
  source 1..80: mol_type = other DNA

SEQ ID NO: 16978 - DNA, 217 bp, synthetic construct; identical to SEQ ID NO: 6365
  misc_feature 1..217: note = Synthetic polypeptide
  source 1..217: mol_type = other DNA

SEQ ID NO: 16979 - DNA, 337 bp, synthetic construct; identical to SEQ ID NO: 6393
  misc_feature 1..337: note = Synthetic polypeptide
  source 1..337: mol_type = other DNA

SEQ ID NO: 16980 - DNA, 382 bp, synthetic construct; identical to SEQ ID NO: 434
  misc_feature 1..382: note = Synthetic polypeptide
  source 1..382: mol_type = other DNA

SEQ ID NO: 16981 - DNA, 67 bp, synthetic construct; identical to SEQ ID NO: 16124
  misc_feature 1..67: note = Synthetic polypeptide
  source 1..67: mol_type = other DNA

SEQ ID NO: 16982 - DNA, 792 bp, synthetic construct; identical to SEQ ID NO: 6418
  misc_feature 1..792: note = Synthetic polypeptide
  source 1..792: mol_type = other DNA

SEQ ID NO: 16983 - DNA, 369 bp, synthetic construct; identical to SEQ ID NO: 6419
  misc_feature 1..369: note = Synthetic polypeptide
  source 1..369: mol_type = other DNA

SEQ ID NO: 16984 - DNA, 249 bp, synthetic construct; identical to SEQ ID NO: 6420
  misc_feature 1..249: note = Synthetic polypeptide
  source 1..249: mol_type = other DNA

SEQ ID NO: 16985 - DNA, 369 bp, synthetic construct; identical to SEQ ID NO: 6421
  misc_feature 1..369: note = Synthetic polypeptide
  source 1..369: mol_type = other DNA

SEQ ID NO: 16986 - DNA, 843 bp, synthetic construct; identical to SEQ ID NO: 6422
  misc_feature 1..843: note = Synthetic polypeptide
  source 1..843: mol_type = other DNA

SEQ ID NO: 16987 - DNA, 943 bp, synthetic construct; identical to SEQ ID NO: 9889
  misc_feature 1..943: note = Synthetic polypeptide
  source 1..943: mol_type = other DNA

SEQ ID NO: 16988 - DNA, 427 bp, synthetic construct; identical to SEQ ID NO: 573
  misc_feature 1..427: note = Synthetic polypeptide
  source 1..427: mol_type = other DNA

SEQ ID NO: 16989 - DNA, 1883 bp, synthetic construct; identical to SEQ ID NO: 6345
  misc_feature 1..1883: note = Synthetic polypeptide
  source 1..1883: mol_type = other DNA

SEQ ID NO: 16990 - DNA, 665 bp, synthetic construct; identical to SEQ ID NO: 6374
  misc_feature 1..665: note = Synthetic polypeptide
  source 1..665: mol_type = other DNA

SEQ ID NO: 16991 - DNA, 518 bp, synthetic construct; identical to SEQ ID NO: 6375
  misc_feature 1..518: note = Synthetic polypeptide
  source 1..518: mol_type = other DNA

SEQ ID NO: 16992 - DNA, 560 bp, synthetic construct; identical to SEQ ID NO: 6322
  misc_feature 1..560: note = Synthetic polypeptide
  source 1..560: mol_type = other DNA

SEQ ID NO: 16993 - DNA, 893 bp, synthetic construct; identical to SEQ ID NO: 12957
  misc_feature 1..893: note = Synthetic polypeptide
  source 1..893: mol_type = other DNA

SEQ ID NO: 16994 - DNA, 959 bp, synthetic construct; identical to SEQ ID NO: 12958
  misc_feature 1..959: note = Synthetic polypeptide
  source 1..959: mol_type = other DNA

SEQ ID NO: 16995 - DNA, 1028 bp, synthetic construct; identical to SEQ ID NO: 12959
  misc_feature 1..1028: note = Synthetic polypeptide
  source 1..1028: mol_type = other DNA

SEQ ID NO: 16996 - DNA, 887 bp, synthetic construct; identical to SEQ ID NO: 12960
  misc_feature 1..887: note = Synthetic polypeptide
  source 1..887: mol_type = other DNA

SEQ ID NO: 16997 - DNA, 851 bp, synthetic construct; identical to SEQ ID NO: 12778
  misc_feature 1..851: note = Synthetic polypeptide
  source 1..851: mol_type = other DNA

SEQ ID NO: 16998 - DNA, 815 bp, synthetic construct; identical to SEQ ID NO: 12782
  misc_feature 1..815: note = Synthetic polypeptide
  source 1..815: mol_type = other DNA

SEQ ID NO: 16999 - DNA, 833 bp, synthetic construct; identical to SEQ ID NO: 12781
  misc_feature 1..833: note = Synthetic polypeptide
  source 1..833: mol_type = other DNA

SEQ ID NO: 17000 - DNA, 2157 bp, synthetic construct; identical to SEQ ID NO: 6426
  misc_feature 1..2157: note = Synthetic polypeptide
  source 1..2157: mol_type = other DNA

SEQ ID NO: 17001 - DNA, 799 bp, synthetic construct; identical to SEQ ID NO: 6427
  misc_feature 1..799: note = Synthetic polypeptide
  source 1..799: mol_type = other DNA

SEQ ID NO: 17002 - DNA, 336 bp, synthetic construct; identical to SEQ ID NO: 6428
  misc_feature 1..336: note = Synthetic polypeptide
  source 1..336: mol_type = other DNA

SEQ ID NO: 17003 - DNA, 540 bp, synthetic construct; identical to SEQ ID NO: 6513
  misc_feature 1..540: note = Synthetic polypeptide
  source 1..540: mol_type = other DNA

SEQ ID NO: 17004 - DNA, 651 bp, synthetic construct; identical to SEQ ID NO: 6514
  misc_feature 1..651: note = Synthetic polypeptide
  source 1..651: mol_type = other DNA

SEQ ID NO: 17005 - DNA, 569 bp, synthetic construct; identical to SEQ ID NO: 6515
  misc_feature 1..569: note = Synthetic polypeptide
  source 1..569: mol_type = other DNA

SEQ ID NO: 17006 - DNA, 152 bp, synthetic construct; identical to SEQ ID NO: 6516
  misc_feature 1..152: note = Synthetic polypeptide
  source 1..152: mol_type = other DNA

SEQ ID NO: 17007 - DNA, 181 bp, synthetic construct
  misc_feature 1..181: note = Synthetic polypeptide
  source 1..181: mol_type = other DNA
gtggtggtgaggaaggatccctggacctgagaggtctgacttgggttctggtctcagccatccacttatcagttgtggaaccttgggcccaggctttggtgcagtacctggaggagcccctcacccaagtggcggcatcttaacggcattggtggaagctggggtcagaaaagagaaatga

SEQ ID NO: 17008 - DNA, 143 bp, synthetic construct
  misc_feature 1..143: note = Synthetic polypeptide
  source 1..143: mol_type = other DNA
gtggtggtgaggaaggatccctggacctgagaggtctgacttgggttctggtctcagccatccacttatcagttgtggaaccttgggcccaggctttggtgcagtacctggaggagcccctcacccaagtggcggcatcttaa

SEQ ID NO: 17009 - DNA, 259 bp, synthetic construct; identical to SEQ ID NO: 7895
  misc_feature 1..259: note = Synthetic polypeptide
  source 1..259: mol_type = other DNA

SEQ ID NO: 17010 - DNA, 310 bp, synthetic construct; identical to SEQ ID NO: 7896
  misc_feature 1..310: note = Synthetic polypeptide
  source 1..310: mol_type = other DNA

SEQ ID NO: 17011 - DNA, 586 bp, synthetic construct
  misc_feature 1..586: note = Synthetic polypeptide
  source 1..586: mol_type = other DNA
ctcctggaatcttagtttcttcatttgcaaaaagtagacaggaacttctcccctgcggggttgcaatgggaattggagaaaatatatttcaagtgccttgcgcgatgcccggcaccgaggcacttggcggcactcaatatctgggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatag

SEQ ID NO: 17012 - DNA, 236 bp, synthetic construct; identical to SEQ ID NO: 9570
  misc_feature 1..236: note = Synthetic polypeptide
  source 1..236: mol_type = other DNA

SEQ ID NO: 17013 - DNA, 542 bp, synthetic construct; identical to SEQ ID NO: 9571
  misc_feature 1..542: note = Synthetic polypeptide
  source 1..542: mol_type = other DNA

SEQ ID NO: 17014 - DNA, 1214 bp, synthetic construct; identical to SEQ ID NO: 9572
  misc_feature 1..1214: note = Synthetic polypeptide
  source 1..1214: mol_type = other DNA

SEQ ID NO: 17015 - DNA, 144 bp, synthetic construct; identical to SEQ ID NO: 9573
  misc_feature 1..144: note = Synthetic polypeptide
  source 1..144: mol_type = other DNA

SEQ ID NO: 17016 - DNA, 515 bp, synthetic construct; identical to SEQ ID NO: 9574
  misc_feature 1..515: note = Synthetic polypeptide
  source 1..515: mol_type = other DNA

SEQ ID NO: 17017 - DNA, 148 bp, synthetic construct; identical to SEQ ID NO: 6388
  misc_feature 1..148: note = Synthetic polypeptide
  source 1..148: mol_type = other DNA

SEQ ID NO: 17018 - DNA, 1100 bp, synthetic construct; identical to SEQ ID NO: 6389
  misc_feature 1..1100: note = Synthetic polypeptide
  source 1..1100: mol_type = other DNA

SEQ ID NO: 17019 - DNA, 464 bp, synthetic construct; identical to SEQ ID NO: 6390
  misc_feature 1..464: note = Synthetic polypeptide
  source 1..464: mol_type = other DNA

SEQ ID NO: 17020 - DNA, 280 bp, synthetic construct; identical to SEQ ID NO: 6391
  misc_feature 1..280: note = Synthetic polypeptide
  source 1..280: mol_type = other DNA

SEQ ID NO: 17021 - DNA, 374 bp, synthetic construct; identical to SEQ ID NO: 10336
  misc_feature 1..374: note = Synthetic polypeptide
  source 1..374: mol_type = other DNA

SEQ ID NO: 17022 - DNA, 405 bp, synthetic construct; identical to SEQ ID NO: 7860
  misc_feature 1..405: note = Synthetic polypeptide
  source 1..405: mol_type = other DNA

SEQ ID NO: 17023 - DNA, 274 bp, synthetic construct; identical to SEQ ID NO: 7861
  misc_feature 1..274: note = Synthetic polypeptide
  source 1..274: mol_type = other DNA

SEQ ID NO: 17024 - DNA, 196 bp, synthetic construct; identical to SEQ ID NO: 7862
  misc_feature 1..196: note = Synthetic polypeptide
  source 1..196: mol_type = other DNA

SEQ ID NO: 17025 - DNA, 268 bp, synthetic construct; identical to SEQ ID NO: 7863
  misc_feature 1..268: note = Synthetic polypeptide
  source 1..268: mol_type = other DNA

SEQ ID NO: 17026 - DNA, 186 bp, synthetic construct; identical to SEQ ID NO: 7864
  misc_feature 1..186: note = Synthetic polypeptide
  source 1..186: mol_type = other DNA

SEQ ID NO: 17027 - DNA, 522 bp, synthetic construct
  misc_feature 1..522: note = Synthetic polypeptide
  source 1..522: mol_type = other DNA
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17028 - DNA, 603 bp, synthetic construct
  misc_feature 1..603: note = Synthetic polypeptide
  source 1..603: mol_type = other DNA
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17029 - DNA, 321 bp, synthetic construct
  misc_feature 1..321: note = Synthetic polypeptide
  source 1..321: mol_type = other DNA
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatggcaaatcgaagggagagtggttga

SEQ ID NO: 17030 - DNA, 359 bp, synthetic construct
  misc_feature 1..359: note = Synthetic polypeptide
  source 1..359: mol_type = other DNA
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggta

SEQ ID NO: 17031 - DNA, 347 bp, synthetic construct
  misc_feature 1..347: note = Synthetic polypeptide
  source 1..347: mol_type = other DNA
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttga

SEQ ID NO: 17032 - DNA, 1365 bp, synthetic construct; identical to SEQ ID NO: 8252
  misc_feature 1..1365: note = Synthetic polypeptide
  source 1..1365: mol_type = other DNA

SEQ ID NO: 17033 - DNA, 797 bp, synthetic construct; identical to SEQ ID NO: 12733
  misc_feature 1..797: note = Synthetic polypeptide
  source 1..797: mol_type = other DNA

SEQ ID NO: 17034 - DNA, 527 bp, synthetic construct; identical to SEQ ID NO: 7665
  misc_feature 1..527: note = Synthetic polypeptide
  source 1..527: mol_type = other DNA

SEQ ID NO: 17035 - DNA, 773 bp, synthetic construct; identical to SEQ ID NO: 10251
  misc_feature 1..773: note = Synthetic polypeptide
  source 1..773: mol_type = other DNA

SEQ ID NO: 17036 - DNA, 595 bp, synthetic construct; identical to SEQ ID NO: 12829
  misc_feature 1..595: note = Synthetic polypeptide
  source 1..595: mol_type = other DNA

SEQ ID NO: 17037 - DNA, 523 bp, synthetic construct; identical to SEQ ID NO: 8925
  misc_feature 1..523: note = Synthetic polypeptide
  source 1..523: mol_type = other DNA

SEQ ID NO: 17038 - DNA, 853 bp, synthetic construct; identical to SEQ ID NO: 8074
  misc_feature 1..853: note = Synthetic polypeptide
  source 1..853: mol_type = other DNA

SEQ ID NO: 17039 - DNA, 545 bp, synthetic construct; identical to SEQ ID NO: 7336
  misc_feature 1..545: note = Synthetic polypeptide
  source 1..545: mol_type = other DNA

SEQ ID NO: 17040 - DNA, 282 bp, synthetic construct; identical to SEQ ID NO: 7621
  misc_feature 1..282: note = Synthetic polypeptide
  source 1..282: mol_type = other DNA

SEQ ID NO: 17041 - DNA, 348 bp, synthetic construct; identical to SEQ ID NO: 6363
  misc_feature 1..348: note = Synthetic polypeptide
  source 1..348: mol_type = other DNA

SEQ ID NO: 17042 - DNA, 2448 bp, synthetic construct; identical to SEQ ID NO: 6618
  misc_feature 1..2448: note = Synthetic polypeptide
  source 1..2448: mol_type = other DNA

SEQ ID NO: 17043 - DNA, 1543 bp, synthetic construct; identical to SEQ ID NO: 6619
  misc_feature 1..1543: note = Synthetic polypeptide
  source 1..1543: mol_type = other DNA

SEQ ID NO: 17044 - DNA, 1468 bp, synthetic construct; identical to SEQ ID NO: 6620
  misc_feature 1..1468: note = Synthetic polypeptide
  source 1..1468: mol_type = other DNA

SEQ ID NO: 17045 - DNA, 2672 bp, synthetic construct; identical to SEQ ID NO: 6621
  misc_feature 1..2672: note = Synthetic polypeptide
  source 1..2672: mol_type = other DNA

SEQ ID NO: 17046 - DNA, 1767 bp, synthetic construct; identical to SEQ ID NO: 6622
  misc_feature 1..1767: note = Synthetic polypeptide
  source 1..1767: mol_type = other DNA

SEQ ID NO: 17047 - DNA, 1692 bp, synthetic construct; identical to SEQ ID NO: 6623
  misc_feature 1..1692: note = Synthetic polypeptide
  source 1..1692: mol_type = other DNA

SEQ ID NO: 17048 - DNA, 369 bp, synthetic construct; identical to SEQ ID NO: 6492
  misc_feature 1..369: note = Synthetic polypeptide
  source 1..369: mol_type = other DNA

SEQ ID NO: 17049 - DNA, 164 bp, synthetic construct; identical to SEQ ID NO: 831
  misc_feature 1..164: note = Synthetic polypeptide
  source 1..164: mol_type = other DNA

SEQ ID NO: 17050 - DNA, 193 bp, synthetic construct; identical to SEQ ID NO: 834
  misc_feature 1..193: note = Synthetic polypeptide
  source 1..193: mol_type = other DNA

SEQ ID NO: 17051 - DNA, 331 bp, synthetic construct; identical to SEQ ID NO: 7504
  misc_feature 1..331: note = Synthetic polypeptide
  source 1..331: mol_type = other DNA

SEQ ID NO: 17052 - DNA, 858 bp, synthetic construct
  misc_feature 1..858: note = Synthetic polypeptide
  source 1..858: mol_type = other DNA
gaccgggcgcggtggctcacgcctataatgccagcactttgggaggctgaggcgggcggatcgcgaggtccggagatcgggaccatcctggctaacatgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17053 - DNA, 939 bp, synthetic construct
  misc_feature 1..939: note = Synthetic polypeptide
  source 1..939: mol_type = other DNA
gaccgggcgcggtggctcacgcctataatgccagcactttgggaggctgaggcgggcggatcgcgaggtccggagatcgggaccatcctggctaacatgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17054 - DNA, 1052 bp, synthetic construct; identical to SEQ ID NO: 447
  misc_feature 1..1052: note = Synthetic polypeptide
  source 1..1052: mol_type = other DNA

SEQ ID NO: 17055 - DNA, 1118 bp, synthetic construct; identical to SEQ ID NO: 448
  misc_feature 1..1118: note = Synthetic polypeptide
  source 1..1118: mol_type = other DNA

SEQ ID NO: 17056 - DNA, 67 bp, synthetic construct; identical to SEQ ID NO: 16124
  misc_feature 1..67: note = Synthetic polypeptide
  source 1..67: mol_type = other DNA

SEQ ID NO: 17057 - DNA, 325 bp, synthetic construct
  misc_feature 1..325: note = Synthetic polypeptide
  source 1..325: mol_type = other DNA
atatctaattcattagccattctattcagctctccctccagaatagatcccaaatccaaccactttgtacaacctctgcagttcctttggacctttgttggcccaggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatag

SEQ ID NO: 17058 - DNA, 108 bp, synthetic construct
  misc_feature 1..108: note = Synthetic polypeptide
  source 1..108: mol_type = other DNA
atatctaattcattagccattctattcagctctccctccagaatagatcccaaatccaaccactttgtacaacctctgcagttcctttggacctttgttggcccagga

SEQ ID NO: 17059 - DNA, 854 bp, synthetic construct; identical to SEQ ID NO: 6577
  misc_feature 1..854: note = Synthetic polypeptide
  source 1..854: mol_type = other DNA

SEQ ID NO: 17060 - DNA, 463 bp, synthetic construct; identical to SEQ ID NO: 588
  misc_feature 1..463: note = Synthetic polypeptide
  source 1..463: mol_type = other DNA

SEQ ID NO: 17061 - DNA, 3055 bp, synthetic construct; identical to SEQ ID NO: 709
  misc_feature 1..3055: note = Synthetic polypeptide
  source 1..3055: mol_type = other DNA

SEQ ID NO: 17062 - DNA, 3058 bp, synthetic construct; identical to SEQ ID NO: 710
  misc_feature 1..3058: note = Synthetic polypeptide
  source 1..3058: mol_type = other DNA

SEQ ID NO: 17063 - DNA, 763 bp, synthetic construct; identical to SEQ ID NO: 606
  misc_feature 1..763: note = Synthetic polypeptide
  source 1..763: mol_type = other DNA

SEQ ID NO: 17064 - DNA, 2471 bp, synthetic construct; identical to SEQ ID NO: 576
  misc_feature 1..2471: note = Synthetic polypeptide
  source 1..2471: mol_type = other DNA

SEQ ID NO: 17065 - DNA, 389 bp, synthetic construct; identical to SEQ ID NO: 12456
  misc_feature 1..389: note = Synthetic polypeptide
  source 1..389: mol_type = other DNA

SEQ ID NO: 17066 - DNA, 695 bp, synthetic construct; identical to SEQ ID NO: 12457
  misc_feature 1..695: note = Synthetic polypeptide
  source 1..695: mol_type = other DNA

SEQ ID NO: 17067 - DNA, 1367 bp, synthetic construct; identical to SEQ ID NO: 12458
  misc_feature 1..1367: note = Synthetic polypeptide
  source 1..1367: mol_type = other DNA

SEQ ID NO: 17068 - DNA, 297 bp, synthetic construct; identical to SEQ ID NO: 12459
  misc_feature 1..297: note = Synthetic polypeptide
  source 1..297: mol_type = other DNA

SEQ ID NO: 17069 - DNA, 668 bp, synthetic construct; identical to SEQ ID NO: 12460
  misc_feature 1..668: note = Synthetic polypeptide
  source 1..668: mol_type = other DNA

SEQ ID NO: 17070 - DNA, 1084 bp, synthetic construct; identical to SEQ ID NO: 580
  misc_feature 1..1084: note = Synthetic polypeptide
  source 1..1084: mol_type = other DNA

SEQ ID NO: 17071 - DNA, 535 bp, synthetic construct
  misc_feature 1..535: note = Synthetic polypeptide
  source 1..535: mol_type = other DNA
gcctgacgcggtggctcatgcctgtaatcccagcactttcggaggccaaggtgggaggatcgcttgagcccaggagttggagaccagcctgggcaacatggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactga

SEQ ID NO: 17072 - DNA, 853 bp, synthetic construct; identical to SEQ ID NO: 10246
  misc_feature 1..853: note = Synthetic polypeptide
  source 1..853: mol_type = other DNA

SEQ ID NO: 17073 - DNA, 423 bp, synthetic construct; identical to SEQ ID NO: 6550
  misc_feature 1..423: note = Synthetic polypeptide
  source 1..423: mol_type = other DNA

SEQ ID NO: 17074 - DNA, 1022 bp, synthetic construct; identical to SEQ ID NO: 590
  misc_feature 1..1022: note = Synthetic polypeptide
  source 1..1022: mol_type = other DNA

SEQ ID NO: 17075 - DNA, 347 bp, synthetic construct; identical to SEQ ID NO: 591
  misc_feature 1..347: note = Synthetic polypeptide
  source 1..347: mol_type = other DNA

SEQ ID NO: 17076 - DNA, 1109 bp, synthetic construct; identical to SEQ ID NO: 592
  misc_feature 1..1109: note = Synthetic polypeptide
  source 1..1109: mol_type = other DNA

SEQ ID NO: 17077 - DNA, 85 bp, synthetic construct; identical to SEQ ID NO: 601
  misc_feature 1..85: note = Synthetic polypeptide
  source 1..85: mol_type = other DNA

SEQ ID NO: 17078 - DNA, 269 bp, synthetic construct; identical to SEQ ID NO: 600
  misc_feature 1..269: note = Synthetic polypeptide
  source 1..269: mol_type = other DNA

SEQ ID NO: 17079 - DNA, 370 bp, synthetic construct; identical to SEQ ID NO: 6522
  misc_feature 1..370: note = Synthetic polypeptide
  source 1..370: mol_type = other DNA

SEQ ID NO: 17080 - DNA, 707 bp, synthetic construct
  misc_feature 1..707: note = Synthetic polypeptide
  source 1..707: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 17081 - DNA, 1013 bp, synthetic construct
  misc_feature 1..1013: note = Synthetic polypeptide
  source 1..1013: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 17082 - DNA, 1685 bp, synthetic construct
  misc_feature 1..1685: note = Synthetic polypeptide
  source 1..1685: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 17083 - DNA, 615 bp, synthetic construct
  misc_feature 1..615: note = Synthetic polypeptide
  source 1..615: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctg

SEQ ID NO: 17084 - DNA, 986 bp, synthetic construct
  misc_feature 1..986: note = Synthetic polypeptide
  source 1..986: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 17085 - DNA, 829 bp, synthetic construct; identical to SEQ ID NO: 624
  misc_feature 1..829: note = Synthetic polypeptide
  source 1..829: mol_type = other DNA

SEQ ID NO: 17086 - DNA, 2825 bp, synthetic construct; identical to SEQ ID NO: 6727
  misc_feature 1..2825: note = Synthetic polypeptide
  source 1..2825: mol_type = other DNA

SEQ ID NO: 17087 - DNA, 1331 bp, synthetic construct; identical to SEQ ID NO: 550
  misc_feature 1..1331: note = Synthetic polypeptide
  source 1..1331: mol_type = other DNA

SEQ ID NO: 17088 - DNA, 1028 bp, synthetic construct; identical to SEQ ID NO: 551
  misc_feature 1..1028: note = Synthetic polypeptide
  source 1..1028: mol_type = other DNA

SEQ ID NO: 17089 - DNA, 1295 bp, synthetic construct; identical to SEQ ID NO: 553
  misc_feature 1..1295: note = Synthetic polypeptide
  source 1..1295: mol_type = other DNA

SEQ ID NO: 17090 - DNA, 1322 bp, synthetic construct; identical to SEQ ID NO: 554
  misc_feature 1..1322: note = Synthetic polypeptide
  source 1..1322: mol_type = other DNA

SEQ ID NO: 17091 - DNA, 1013 bp, synthetic construct; identical to SEQ ID NO: 555
  misc_feature 1..1013: note = Synthetic polypeptide
  source 1..1013: mol_type = other DNA

SEQ ID NO: 17092 - DNA, 718 bp, synthetic construct; identical to SEQ ID NO: 12403
  misc_feature 1..718: note = Synthetic polypeptide
  source 1..718: mol_type = other DNA

SEQ ID NO: 17093 - DNA, 616 bp, synthetic construct; identical to SEQ ID NO: 12404
  misc_feature 1..616: note = Synthetic polypeptide
  source 1..616: mol_type = other DNA

SEQ ID NO: 17094 - DNA, 287 bp, synthetic construct; identical to SEQ ID NO: 7101
  misc_feature 1..287: note = Synthetic polypeptide
  source 1..287: mol_type = other DNA

SEQ ID NO: 17095 - DNA, 281 bp, synthetic construct; identical to SEQ ID NO: 7102
  misc_feature 1..281: note = Synthetic polypeptide
  source 1..281: mol_type = other DNA

SEQ ID NO: 17096 - DNA, 701 bp, synthetic construct; identical to SEQ ID NO: 658
  misc_feature 1..701: note = Synthetic polypeptide
  source 1..701: mol_type = other DNA

SEQ ID NO: 17097 - DNA, 866 bp, synthetic construct
  misc_feature 1..866: note = Synthetic polypeptide
  source 1..866: mol_type = other DNA
caatagtcccatcccccatgttatccacagtttaattttccagtttcagttactcatggtcaactgtggttcgaattttatcctctcacttcatcacaaaaagaaagatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17098 - DNA, 947 bp, synthetic construct
  misc_feature 1..947: note = Synthetic polypeptide
  source 1..947: mol_type = other DNA
caatagtcccatcccccatgttatccacagtttaattttccagtttcagttactcatggtcaactgtggttcgaattttatcctctcacttcatcacaaaaagaaagatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17099 - DNA, 167 bp, synthetic construct
  misc_feature 1..167: note = Synthetic polypeptide
  source 1..167: mol_type = other DNA
ccagtgccctggtggactctcgatgatactagtcgggaaagaggttaaagaagacacgcaagtatgatatcatcaccactccagcagagcgagtggaaatggcgccactaaatgaagaggatgatgaagatgaggactccacagtattcgacatcaaatacaggtaa

SEQ ID NO: 17100 - DNA, 1765 bp, synthetic construct; identical to SEQ ID NO: 6684
  misc_feature 1..1765: note = Synthetic polypeptide
  source 1..1765: mol_type = other DNA

SEQ ID NO: 17101 - DNA, 1588 bp, synthetic construct
  misc_feature 1..1588: note = Synthetic polypeptide
  source 1..1588: mol_type = other DNA
ccactgccaccaagccaagccaccaccaaccctaacctgcctagtccctctgctcctgctctggcaccccacaggtctttcctacatggagtggggaccaccaggtcatgtcagtgtcctgcttacacccttcagtgcttcctggtgctgcctgatgcacctgagaaaatgccagccctcagccatctcctcttcccaggatctccctgcatctcaagccctggctttgtagcagtttccatgggttctttctattccttgaagaccccgaacttgtctcctagaactttgcattttctgttccctctgcatagaatacccttctccagatcttcccacagatgcctcctggcaattcagatctctgttctgttctaatgtcaactcctcaaggaagtcctcttgatcacctcagctaaagtggccctcactttcctcaccacccccacaccccagttgccatcccagcatcttcctttactttcttcatagtacatatcactgtcgagatggcctgttttattcatttgtgacatctgtgttgtcaccctccctagttccttgagggcagggcattgcctgtcaggtgcacagctgtctcctagcatgtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtga

SEQ ID NO: 17102 - DNA, 382 bp, synthetic construct; identical to SEQ ID NO: 434
  misc_feature 1..382: note = Synthetic polypeptide
  source 1..382: mol_type = other DNA

SEQ ID NO: 17103 - DNA, 259 bp, synthetic construct; identical to SEQ ID NO: 7895
  misc_feature 1..259: note = Synthetic polypeptide
  source 1..259: mol_type = other DNA

SEQ ID NO: 17104 - DNA, 310 bp, synthetic construct; identical to SEQ ID NO: 7896
  misc_feature 1..310: note = Synthetic polypeptide
  source 1..310: mol_type = other DNA

SEQ ID NO: 17105 - DNA, 560 bp, synthetic construct; identical to SEQ ID NO: 6322
  misc_feature 1..560: note = Synthetic polypeptide
  source 1..560: mol_type = other DNA

SEQ ID NO: 17106 - DNA, 742 bp, synthetic construct; identical to SEQ ID NO: 6357
  misc_feature 1..742: note = Synthetic polypeptide
  source 1..742: mol_type = other DNA

SEQ ID NO: 17107 - DNA, 590 bp, synthetic construct; identical to SEQ ID NO: 6358
  misc_feature 1..590: note = Synthetic polypeptide
  source 1..590: mol_type = other DNA

SEQ ID NO: 17108 - DNA, 577 bp, synthetic construct; identical to SEQ ID NO: 6359
  misc_feature 1..577: note = Synthetic polypeptide
  source 1..577: mol_type = other DNA

SEQ ID NO: 17109 - DNA, 430 bp, synthetic construct; identical to SEQ ID NO: 6360
  misc_feature 1..430: note = Synthetic polypeptide
  source 1..430: mol_type = other DNA

SEQ ID NO: 17110 - DNA, 670 bp, synthetic construct; identical to SEQ ID NO: 6361
  misc_feature 1..670: note = Synthetic polypeptide
  source 1..670: mol_type = other DNA

SEQ ID NO: 17111 - DNA, 1516 bp, synthetic construct; identical to SEQ ID NO: 534
  misc_feature 1..1516: note = Synthetic polypeptide
  source 1..1516: mol_type = other DNA

SEQ ID NO: 17112 - DNA, 591 bp, synthetic construct; identical to SEQ ID NO: 539
  misc_feature 1..591: note = Synthetic polypeptide
  source 1..591: mol_type = other DNA

SEQ ID NO: 17113 - DNA, 482 bp, synthetic construct; identical to SEQ ID NO: 540
  misc_feature 1..482: note = Synthetic polypeptide
  source 1..482: mol_type = other DNA

SEQ ID NO: 17114 - DNA, 444 bp, synthetic construct; identical to SEQ ID NO: 541
  misc_feature 1..444: note = Synthetic polypeptide
  source 1..444: mol_type = other DNA

SEQ ID NO: 17115 - DNA, 334 bp, synthetic construct; identical to SEQ ID NO: 533
  misc_feature 1..334: note = Synthetic polypeptide
  source 1..334: mol_type = other DNA

SEQ ID NO: 17116 - DNA, 38 bp, synthetic construct; identical to SEQ ID NO: 543
  misc_feature 1..38: note = Synthetic polypeptide
  source 1..38: mol_type = other DNA

SEQ ID NO: 17117 - DNA, 245 bp, synthetic construct; identical to SEQ ID NO: 542
  misc_feature 1..245: note = Synthetic polypeptide
  source 1..245: mol_type = other DNA

SEQ ID NO: 17118 - DNA, 792 bp, synthetic construct; identical to SEQ ID NO: 6418
  misc_feature 1..792: note = Synthetic polypeptide
  source 1..792: mol_type = other DNA

SEQ ID NO: 17119 - DNA, 369 bp, synthetic construct; identical to SEQ ID NO: 6419
  misc_feature 1..369: note = Synthetic polypeptide
  source 1..369: mol_type = other DNA

SEQ ID NO: 17120 - DNA, 249 bp, synthetic construct; identical to SEQ ID NO: 6420
  misc_feature 1..249: note = Synthetic polypeptide
  source 1..249: mol_type = other DNA

SEQ ID NO: 17121 - DNA, 369 bp, synthetic construct; identical to SEQ ID NO: 6421
  misc_feature 1..369: note = Synthetic polypeptide
  source 1..369: mol_type = other DNA

SEQ ID NO: 17122 - DNA, 843 bp, synthetic construct; identical to SEQ ID NO: 6422
  misc_feature 1..843: note = Synthetic polypeptide
  source 1..843: mol_type = other DNA

SEQ ID NO: 17123 - DNA, 871 bp, synthetic construct; identical to SEQ ID NO: 437
  misc_feature 1..871: note = Synthetic polypeptide
  source 1..871: mol_type = other DNA

SEQ ID NO: 17124 - DNA, 421 bp, synthetic construct; identical to SEQ ID NO: 441
  misc_feature 1..421: note = Synthetic polypeptide
  source 1..421: mol_type = other DNA

SEQ ID NO: 17125 - DNA, 638 bp, synthetic construct; identical to SEQ ID NO: 442
  misc_feature 1..638: note = Synthetic polypeptide
  source 1..638: mol_type = other DNA

SEQ ID NO: 17126 - DNA, 337 bp, synthetic construct; identical to SEQ ID NO: 443
  misc_feature 1..337: note = Synthetic polypeptide
  source 1..337: mol_type = other DNA

SEQ ID NO: 17127 - DNA, 163 bp, synthetic construct; identical to SEQ ID NO: 480
  misc_feature 1..163: note = Synthetic polypeptide
  source 1..163: mol_type = other DNA

SEQ ID NO: 17128 - DNA, 104 bp, synthetic construct; identical to SEQ ID NO: 481
  misc_feature 1..104: note = Synthetic polypeptide
  source 1..104: mol_type = other DNA

SEQ ID NO: 17129 - DNA, 337 bp, synthetic construct; identical to SEQ ID NO: 6393
  misc_feature 1..337: note = Synthetic polypeptide
  source 1..337: mol_type = other DNA

SEQ ID NO: 17130 - DNA, 1004 bp, synthetic construct; identical to SEQ ID NO: 8920
  misc_feature 1..1004: note = Synthetic polypeptide
  source 1..1004: mol_type = other DNA

SEQ ID NO: 17131 - DNA, 887 bp, synthetic construct; identical to SEQ ID NO: 8921
  misc_feature 1..887: note = Synthetic polypeptide
  source 1..887: mol_type = other DNA

SEQ ID NO: 17132 - DNA, 80 bp, synthetic construct; identical to SEQ ID NO: 6364
  misc_feature 1..80: note = Synthetic polypeptide
  source 1..80: mol_type = other DNA

SEQ ID NO: 17133 - DNA, 217 bp, synthetic construct; identical to SEQ ID NO: 6365
  misc_feature 1..217: note = Synthetic polypeptide
  source 1..217: mol_type = other DNA

SEQ ID NO: 17134 - DNA, 763 bp, synthetic construct; identical to SEQ ID NO: 606
  misc_feature 1..763: note = Synthetic polypeptide
  source 1..763: mol_type = other DNA

SEQ ID NO: 17135 - DNA, 1133 bp, synthetic construct; identical to SEQ ID NO: 7332
  misc_feature 1..1133: note = Synthetic polypeptide
  source 1..1133: mol_type = other DNA

SEQ ID NO: 17136 - DNA, 1172 bp, synthetic construct; identical to SEQ ID NO: 7333
  misc_feature 1..1172: note = Synthetic polypeptide
  source 1..1172: mol_type = other DNA

SEQ ID NO: 17137 - DNA, 322 bp, synthetic construct; identical to SEQ ID NO: 14839
  misc_feature 1..322: note = Synthetic polypeptide
  source 1..322: mol_type = other DNA

SEQ ID NO: 17138 - DNA, 181 bp, synthetic construct; identical to SEQ ID NO: 17007
  misc_feature 1..181: note = Synthetic polypeptide
  source 1..181: mol_type = other DNA

SEQ ID NO: 17139 - DNA, 143 bp, synthetic construct; identical to SEQ ID NO: 17008
  misc_feature 1..143: note = Synthetic polypeptide
  source 1..143: mol_type = other DNA

SEQ ID NO: 17140 - DNA, 1409 bp, synthetic construct; identical to SEQ ID NO: 14549
  misc_feature 1..1409: note = Synthetic polypeptide
  source 1..1409: mol_type = other DNA

SEQ ID NO: 17141 - DNA, 1463 bp, synthetic construct; identical to SEQ ID NO: 14550
  misc_feature 1..1463: note = Synthetic polypeptide
  source 1..1463: mol_type = other DNA

SEQ ID NO: 17142 - DNA, 1667 bp, synthetic construct; identical to SEQ ID NO: 14551
  misc_feature 1..1667: note = Synthetic polypeptide
  source 1..1667: mol_type = other DNA

SEQ ID NO: 17143 - DNA, 1328 bp, synthetic construct; identical to SEQ ID NO: 14552
  misc_feature 1..1328: note = Synthetic polypeptide
  source 1..1328: mol_type = other DNA

SEQ ID NO: 17144 - DNA, 1406 bp, synthetic construct; identical to SEQ ID NO: 14553
  misc_feature 1..1406: note = Synthetic polypeptide
  source 1..1406: mol_type = other DNA

SEQ ID NO: 17145 - DNA, 1481 bp, synthetic construct; identical to SEQ ID NO: 14554
  misc_feature 1..1481: note = Synthetic polypeptide
  source 1..1481: mol_type = other DNA

SEQ ID NO: 17146 - DNA, 1352 bp, synthetic construct; identical to SEQ ID NO: 14555
  misc_feature 1..1352: note = Synthetic polypeptide
  source 1..1352: mol_type = other DNA

SEQ ID NO: 17147 - DNA, 1307 bp, synthetic construct; identical to SEQ ID NO: 14556
  misc_feature 1..1307: note = Synthetic polypeptide
  source 1..1307: mol_type = other DNA

SEQ ID NO: 17148 - DNA, 1562 bp, synthetic construct; identical to SEQ ID NO: 14557
  misc_feature 1..1562: note = Synthetic polypeptide
  source 1..1562: mol_type = other DNA

SEQ ID NO: 17149 - DNA, 2157 bp, synthetic construct; identical to SEQ ID NO: 6426
  misc_feature 1..2157: note = Synthetic polypeptide
  source 1..2157: mol_type = other DNA

SEQ ID NO: 17150 - DNA, 799 bp, synthetic construct; identical to SEQ ID NO: 6427
  misc_feature 1..799: note = Synthetic polypeptide
  source 1..799: mol_type = other DNA

SEQ ID NO: 17151 - DNA, 336 bp, synthetic construct; identical to SEQ ID NO: 6428
  misc_feature 1..336: note = Synthetic polypeptide
  source 1..336: mol_type = other DNA

SEQ ID NO: 17152 - DNA, 665 bp, synthetic construct; identical to SEQ ID NO: 6374
  misc_feature 1..665: note = Synthetic polypeptide
  source 1..665: mol_type = other DNA

SEQ ID NO: 17153 - DNA, 518 bp, synthetic construct; identical to SEQ ID NO: 6375
  misc_feature 1..518: note = Synthetic polypeptide
  source 1..518: mol_type = other DNA

SEQ ID NO: 17154 - DNA, 572 bp, synthetic construct
  misc_feature 1..572: note = Synthetic polypeptide
  source 1..572: mol_type = other DNA
gctgggcacagtggctcaagcctgtaatcctagcactttgggaggccgaggtggcaggatcacttgaacccaggagttcaaaaccagcctggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaa

SEQ ID NO: 17155 - DNA, 1033 bp, synthetic construct; identical to SEQ ID NO: 7576
  misc_feature 1..1033: note = Synthetic polypeptide
  source 1..1033: mol_type = other DNA

SEQ ID NO: 17156 - DNA, 1048 bp, synthetic construct; identical to SEQ ID NO: 7577
  misc_feature 1..1048: note = Synthetic polypeptide
  source 1..1048: mol_type = other DNA

SEQ ID NO: 17157 - DNA, 1883 bp, synthetic construct; identical to SEQ ID NO: 6345
  misc_feature 1..1883: note = Synthetic polypeptide
  source 1..1883: mol_type = other DNA

SEQ ID NO: 17158 - DNA, 422 bp, synthetic construct
  misc_feature 1..422: note = Synthetic polypeptide
  source 1..422: mol_type = other DNA
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 17159 - DNA, 470 bp, synthetic construct
  misc_feature 1..470: note = Synthetic polypeptide
  source 1..470: mol_type = other DNA
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 17160 - DNA, 326 bp, synthetic construct
  misc_feature 1..326: note = Synthetic polypeptide
  source 1..326: mol_type = other DNA
gcacggggcttggcaacatggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 17161 - DNA, 395 bp, synthetic construct
  misc_feature 1..395: note = Synthetic polypeptide
  source 1..395: mol_type = other DNA
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaa

SEQ ID NO: 17162 - DNA, 751 bp, synthetic construct
  misc_feature 1..751: note = Synthetic polypeptide
  source 1..751: mol_type = other DNA
tgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggagacatcagaatccctgtgctttgccgctgggggtgtgaaatggtgcagccactgtggaagacagtatgacagctcctcagaaggttcaacatagaatcaccagagaagcataaaccccaaagaggtgaaacagggacccaaatggatgcttttctatgaatattcatggcagcacctttcacagtggccaaaaggtggaaatgactcaagtgtgctccagcagaggaatgagtaaacaaatgtgttacaagcacacaacagaatcttactcagccatgaaaaggaatgaaattctgacacaggctacagcatggatggcccgaggtcattatgctgagtgaaataagccagtcacaacagggcacaccctgcgggattccgtaaacaaggcacctagagccgtcagattcagagagacagaaagtggactggaatttgagagcgtattttgcggtaaaactggccgaaggctaaagctgaccagaccggactccttggtgacctgtcctgcacaggggagtttacagagcagcccctcgatggagatcaagtga

SEQ ID NO: 17163 - DNA, 423 bp, synthetic construct; identical to SEQ ID NO: 6550
  misc_feature 1..423: note = Synthetic polypeptide
  source 1..423: mol_type = other DNA

SEQ ID NO: 17164 - DNA, 540 bp, synthetic construct; identical to SEQ ID NO: 6513
  misc_feature 1..540: note = Synthetic polypeptide
  source 1..540: mol_type = other DNA

SEQ ID NO: 17165 - DNA, 651 bp, synthetic construct; identical to SEQ ID NO: 6514
  misc_feature 1..651: note = Synthetic polypeptide
  source 1..651: mol_type = other DNA

SEQ ID NO: 17166 - DNA, 569 bp, synthetic construct; identical to SEQ ID NO: 6515
  misc_feature 1..569: note = Synthetic polypeptide
  source 1..569: mol_type = other DNA

SEQ ID NO: 17167 - DNA, 152 bp, synthetic construct; identical to SEQ ID NO: 6516
  misc_feature 1..152: note = Synthetic polypeptide
  source 1..152: mol_type = other DNA

SEQ ID NO: 17168 - DNA, 471 bp, synthetic construct; identical to SEQ ID NO: 12833
  misc_feature 1..471: note = Synthetic polypeptide
  source 1..471: mol_type = other DNA

SEQ ID NO: 17169 - DNA, 519 bp, synthetic construct; identical to SEQ ID NO: 12834
  misc_feature 1..519: note = Synthetic polypeptide
  source 1..519: mol_type = other DNA

SEQ ID NO: 17170 - DNA, 293 bp, synthetic construct; identical to SEQ ID NO: 12835
  misc_feature 1..293: note = Synthetic polypeptide
  source 1..293: mol_type = other DNA

SEQ ID NO: 17171 - DNA, 168 bp, synthetic construct; identical to SEQ ID NO: 12836
  misc_feature 1..168: note = Synthetic polypeptide
  source 1..168: mol_type = other DNA

SEQ ID NO: 17172 - DNA, 126 bp, synthetic construct; identical to SEQ ID NO: 12837
  misc_feature 1..126: note = Synthetic polypeptide
  source 1..126: mol_type = other DNA

SEQ ID NO: 17173 - DNA, 622 bp, synthetic construct
  misc_feature 1..622: note = Synthetic polypeptide
  source 1..622: mol_type = other DNA
ctccctgggcctcagtctcctcttctgtaaaatggggagaacagaggcctccaccccacctcccggctgctggaagggcccaacgagacagctccaccatgcctgcaatggacccggcttgtctgtgctgtgcttcatgcgtcacgacatcctggagtatttcagtgtctacgggacagccctgagcatgtgggtctcgctgatggcactggccgacttcgacgaacccaagaggtcaacatttgtgatgttcggcgtcctgaccattgctgtgcggatctaccatgaccgatggggctacggggtgtactcgggccccatcggcacagccatcctcatcatcgcggcaaagtggctacagaagatgaaggagaagaagggcctgtacccagacaagagcgtctacacccagcagataggccccggcctctgcttcggggcgctggccctgatgctacgcttcttctttgaggactgggactacacttatgtccacagcttctaccactgtgccctggctatgtcctttgttctgctgctgcccaaggtcaacaagaaggctggatccccggggaccccggccaagctggactgctccaccctgtgctgtgcttgtgtctga

SEQ ID NO: 17174 - DNA, 369 bp, synthetic construct; identical to SEQ ID NO: 6492
  misc_feature 1..369: note = Synthetic polypeptide
  source 1..369: mol_type = other DNA

SEQ ID NO: 17175 - DNA, 733 bp, synthetic construct; identical to SEQ ID NO: 6880
  misc_feature 1..733: note = Synthetic polypeptide
  source 1..733: mol_type = other DNA

SEQ ID NO: 17176 - DNA, 273 bp, synthetic construct; identical to SEQ ID NO: 6881
  misc_feature 1..273: note = Synthetic polypeptide
  source 1..273: mol_type = other DNA

SEQ ID NO: 17177 - DNA, 1045 bp, synthetic construct; identical to SEQ ID NO: 8898
  misc_feature 1..1045: note = Synthetic polypeptide
  source 1..1045: mol_type = other DNA

SEQ ID NO: 17178 - DNA, 387 bp, synthetic construct; identical to SEQ ID NO: 16776
  misc_feature 1..387: note = Synthetic polypeptide
  source 1..387: mol_type = other DNA

SEQ ID NO: 17179 - DNA, 1629 bp, synthetic construct; identical to SEQ ID NO: 8070
  misc_feature 1..1629: note = Synthetic polypeptide
  source 1..1629: mol_type = other DNA

SEQ ID NO: 17180 - DNA, 1500 bp, synthetic construct; identical to SEQ ID NO: 8071
  misc_feature 1..1500: note = Synthetic polypeptide
  source 1..1500: mol_type = other DNA

SEQ ID NO: 17181 - DNA, 2109 bp, synthetic construct; identical to SEQ ID NO: 14945
  misc_feature 1..2109: note = Synthetic polypeptide
  source 1..2109: mol_type = other DNA

SEQ ID NO: 17182 - DNA, 1084 bp, synthetic construct; identical to SEQ ID NO: 580
  misc_feature 1..1084: note = Synthetic polypeptide
  source 1..1084: mol_type = other DNA

SEQ ID NO: 17183 - DNA, 355 bp, synthetic construct; identical to SEQ ID NO: 8039
  misc_feature 1..355: note = Synthetic polypeptide
  source 1..355: mol_type = other DNA

SEQ ID NO: 17184 - DNA, 322 bp, synthetic construct
  misc_feature 1..322: note = Synthetic polypeptide
  source 1..322: mol_type = other DNA
ggccaagcacaatgagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattag

SEQ ID NO: 17185 - DNA, 191 bp, synthetic construct
  misc_feature 1..191: note = Synthetic polypeptide
  source 1..191: mol_type = other DNA
ggccaagcacaatgagcttgctccctacgatgagaactggttctacacgcgagctggtggtttaatcctttctatatacacggaggcagactccctgggtttggatccatcttttacatctggctgtgtgtcctctgcttccacagcgcggcacctgtacctccggggtggcgctggggttggctccatga

SEQ ID NO: 17186 - DNA, 113 bp, synthetic construct
  misc_feature 1..113: note = Synthetic polypeptide
  source 1..113: mol_type = other DNA
ggccaagcacaatgagcttgctccctacgatgagaactggttctacacgcgagctgcttccacagcgcggcacctgtacctccggggtggcgctggggttggctccatgacca

SEQ ID NO: 17187 - DNA, 103 bp, synthetic construct
  misc_feature 1..103: note = Synthetic polypeptide
  source 1..103: mol_type = other DNA
ggccaagcacaatgagcttgctccctacgatgagaactggttctacacgcgagctgagttgcactgtcaccaggctggagtacactggtgccgtctcggctaa

SEQ ID NO: 17188 - DNA, 185 bp, synthetic construct
  misc_feature 1..185: note = Synthetic polypeptide
  source 1..185: mol_type = other DNA
ggccaagcacaatgagcttgctccctacgatgagaactggttctacacgcgagctggtgaggaacttagcttccacagcgcggcacctgtacctccggggtggcgctggggttggctccatgaccaagatctatgggggacgtcagagaaacggcgtcatgcccagccacttcagccgaggctcc

SEQ ID NO: 17189 - DNA, 1871 bp, synthetic construct; identical to SEQ ID NO: 10627
  misc_feature 1..1871: note = Synthetic polypeptide
  source 1..1871: mol_type = other DNA

SEQ ID NO: 17190 - DNA, 1625 bp, synthetic construct; identical to SEQ ID NO: 10628
  misc_feature 1..1625: note = Synthetic polypeptide
  source 1..1625: mol_type = other DNA

SEQ ID NO: 17191 - DNA, 446 bp, synthetic construct; identical to SEQ ID NO: 10629
  misc_feature 1..446: note = Synthetic polypeptide
  source 1..446: mol_type = other DNA

SEQ ID NO: 17192 - DNA, 1086 bp, synthetic construct; identical to SEQ ID NO: 6423
  misc_feature 1..1086: note = Synthetic polypeptide
  source 1..1086: mol_type = other DNA

SEQ ID NO: 17193 - DNA, 330 bp, synthetic construct; identical to SEQ ID NO: 6490
  misc_feature 1..330: note = Synthetic polypeptide
  source 1..330: mol_type = other DNA

SEQ ID NO: 17194 - DNA, 67 bp, synthetic construct; identical to SEQ ID NO: 16124
  misc_feature 1..67: note = Synthetic polypeptide
  source 1..67: mol_type = other DNA

SEQ ID NO: 17195 - DNA, 1148 bp, synthetic construct
  misc_feature 1..1148: note = Synthetic polypeptide
  source 1..1148: mol_type = other DNA
cagtgattctcaaactcaagagcctcgggttctggcaaggtgccttagggacacagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 17196 - DNA, 618 bp, synthetic construct; identical to SEQ ID NO: 12830
  misc_feature 1..618: note = Synthetic polypeptide
  source 1..618: mol_type = other DNA

SEQ ID NO: 17197 - DNA, 594 bp, synthetic construct; identical to SEQ ID NO: 12831
  misc_feature 1..594: note = Synthetic polypeptide
  source 1..594: mol_type = other DNA

SEQ ID NO: 17198 - DNA, 636 bp, synthetic construct; identical to SEQ ID NO: 12832
  misc_feature 1..636: note = Synthetic polypeptide
  source 1..636: mol_type = other DNA

SEQ ID NO: 17199 - DNA, 545 bp, synthetic construct; identical to SEQ ID NO: 7336
  misc_feature 1..545: note = Synthetic polypeptide
  source 1..545: mol_type = other DNA

SEQ ID NO: 17200 - DNA, 529 bp, synthetic construct; identical to SEQ ID NO: 12735
  misc_feature 1..529: note = Synthetic polypeptide
  source 1..529: mol_type = other DNA

SEQ ID NO: 17201 - DNA, 1317 bp, synthetic construct; identical to SEQ ID NO: 12736
  misc_feature 1..1317: note = Synthetic polypeptide
  source 1..1317: mol_type = other DNA

SEQ ID NO: 17202 - DNA, 1221 bp, synthetic construct; identical to SEQ ID NO: 12737
  misc_feature 1..1221: note = Synthetic polypeptide
  source 1..1221: mol_type = other DNA

SEQ ID NO: 17203 - DNA, 1200 bp, synthetic construct; identical to SEQ ID NO: 12738
  misc_feature 1..1200: note = Synthetic polypeptide
  source 1..1200: mol_type = other DNA

SEQ ID NO: 17204 - DNA, 922 bp, synthetic construct; identical to SEQ ID NO: 12739
  misc_feature 1..922: note = Synthetic polypeptide
  source 1..922: mol_type = other DNA

SEQ ID NO: 17205 - DNA, 632 bp, synthetic construct; identical to SEQ ID NO: 12740
  misc_feature 1..632: note = Synthetic polypeptide
  source 1..632: mol_type = other DNA

SEQ ID NO: 17206 - DNA, 836 bp, synthetic construct; identical to SEQ ID NO: 16203
  misc_feature 1..836: note = Synthetic polypeptide
  source 1..836: mol_type = other DNA

SEQ ID NO: 17207 - DNA, 251 bp, synthetic construct; identical to SEQ ID NO: 10592
  misc_feature 1..251: note = Synthetic polypeptide
  source 1..251: mol_type = other DNA

SEQ ID NO: 17208 - DNA, 369 bp, synthetic construct; identical to SEQ ID NO: 6429
  misc_feature 1..369: note = Synthetic polypeptide
  source 1..369: mol_type = other DNA

SEQ ID NO: 17209 - DNA, 201 bp, synthetic construct; identical to SEQ ID NO: 6430
  misc_feature 1..201: note = Synthetic polypeptide
  source 1..201: mol_type = other DNA

SEQ ID NO: 17210 - DNA, 224 bp, synthetic construct
  misc_feature 1..224: note = Synthetic polypeptide
  source 1..224: mol_type = other DNA
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaa

SEQ ID NO: 17211 - DNA, 818 bp, synthetic construct
  misc_feature 1..818: note = Synthetic polypeptide
  source 1..818: mol_type = other DNA
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaa

SEQ ID NO: 17212 - DNA, 1055 bp, synthetic construct
  misc_feature 1..1055: note = Synthetic polypeptide
  source 1..1055: mol_type = other DNA
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaa

SEQ ID NO: 17213 - DNA, 923 bp, synthetic construct
  misc_feature 1..923: note = Synthetic polypeptide
  source 1..923: mol_type = other DNA
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttga

SEQ ID NO: 17214 - DNA, 959 bp, synthetic construct
  misc_feature 1..959: note = Synthetic polypeptide
  source 1..959: mol_type = other DNA
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttga

SEQ ID NO: 17215 - DNA, 769 bp, synthetic construct; identical to SEQ ID NO: 6486
  misc_feature 1..769: note = Synthetic polypeptide
  source 1..769: mol_type = other DNA

SEQ ID NO: 17216 - DNA, 493 bp, synthetic construct; identical to SEQ ID NO: 12530
  misc_feature 1..493: note = Synthetic polypeptide
  source 1..493: mol_type = other DNA

SEQ ID NO: 17217 - DNA, 1206 bp, synthetic construct; identical to SEQ ID NO: 7670
  misc_feature 1..1206: note = Synthetic polypeptide
  source 1..1206: mol_type = other DNA

SEQ ID NO: 17218 - DNA, 1134 bp, synthetic construct; identical to SEQ ID NO: 7671
  misc_feature 1..1134: note = Synthetic polypeptide
  source 1..1134: mol_type = other DNA

SEQ ID NO: 17219 - DNA, 1002 bp, synthetic construct; identical to SEQ ID NO: 7672
  misc_feature 1..1002: note = Synthetic polypeptide
  source 1..1002: mol_type = other DNA

SEQ ID NO: 17220 - DNA, 304 bp, synthetic construct
  misc_feature 1..304: note = Synthetic polypeptide
  source 1..304: mol_type = other DNA
ggccgggtgcggtggctcctgcctgtaatctcagcactttgggaggctggggcgggccgatcccctgagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaa

SEQ ID NO: 17221 - DNA, 280 bp, synthetic construct
  misc_feature 1..280: note = Synthetic polypeptide
  source 1..280: mol_type = other DNA
ggccgggtgcggtggctcctgcctgtaatctcagcactttgggaggctggggcgggccgatcccctgagtggcgcttgaggctacaagtccaagtatcttcagctcaagaagaagttagaagatgagttccccggccgcctggacatcgtgagtcttgggatggggagaaagacttgagcacagccactgtgtcggtccgttaggcctggatggcactgcaggggggttagtgcggcgagggaactccccaggccaccgggttctttgaagtgatggtag

SEQ ID NO: 17222 - DNA, 354 bp, synthetic construct; identical to SEQ ID NO: 8772
  misc_feature 1..354: note = Synthetic polypeptide
  source 1..354: mol_type = other DNA

SEQ ID NO: 17223 - DNA, 354 bp, synthetic construct; identical to SEQ ID NO: 8773
  misc_feature 1..354: note = Synthetic polypeptide
  source 1..354: mol_type = other DNA

SEQ ID NO: 17224 - DNA, 309 bp, synthetic construct; identical to SEQ ID NO: 7876
  misc_feature 1..309: note = Synthetic polypeptide
  source 1..309: mol_type = other DNA

SEQ ID NO: 17225 - DNA, 161 bp, synthetic construct; identical to SEQ ID NO: 7668
  misc_feature 1..161: note = Synthetic polypeptide
  source 1..161: mol_type = other DNA

SEQ ID NO: 17226 - DNA, 178 bp, synthetic construct; identical to SEQ ID NO: 7669
  misc_feature 1..178: note = Synthetic polypeptide
  source 1..178: mol_type = other DNA

SEQ ID NO: 17227 - DNA, 405 bp, synthetic construct; identical to SEQ ID NO: 7860
  misc_feature 1..405: note = Synthetic polypeptide
  source 1..405: mol_type = other DNA

SEQ ID NO: 17228 - DNA, 274 bp, synthetic construct; identical to SEQ ID NO: 7861
  misc_feature 1..274: note = Synthetic polypeptide
  source 1..274: mol_type = other DNA

SEQ ID NO: 17229 - DNA, 196 bp, synthetic construct; identical to SEQ ID NO: 7862
  misc_feature 1..196: note = Synthetic polypeptide
  source 1..196: mol_type = other DNA

SEQ ID NO: 17230 - DNA, 268 bp, synthetic construct; identical to SEQ ID NO: 7863
  misc_feature 1..268: note = Synthetic polypeptide
  source 1..268: mol_type = other DNA

SEQ ID NO: 17231 - DNA, 186 bp, synthetic construct; identical to SEQ ID NO: 7864
  misc_feature 1..186: note = Synthetic polypeptide
  source 1..186: mol_type = other DNA

SEQ ID NO: 17232 - DNA, 893 bp, synthetic construct; identical to SEQ ID NO: 12957
  misc_feature 1..893: note = Synthetic polypeptide
  source 1..893: mol_type = other DNA

SEQ ID NO: 17233 - DNA, 959 bp, synthetic construct; identical to SEQ ID NO: 12958
  misc_feature 1..959: note = Synthetic polypeptide
  source 1..959: mol_type = other DNA

SEQ ID NO: 17234 - DNA, 1028 bp, synthetic construct; identical to SEQ ID NO: 12959
  misc_feature 1..1028: note = Synthetic polypeptide
  source 1..1028: mol_type = other DNA

SEQ ID NO: 17235 - DNA, 887 bp, synthetic construct; identical to SEQ ID NO: 12960
  misc_feature 1..887: note = Synthetic polypeptide
  source 1..887: mol_type = other DNA

SEQ ID NO: 17236 - DNA, 2434 bp, synthetic construct; identical to SEQ ID NO: 16042
  misc_feature 1..2434: note = Synthetic polypeptide
  source 1..2434: mol_type = other DNA

SEQ ID NO: 17237 - DNA, 523 bp, synthetic construct; identical to SEQ ID NO: 8925
  misc_feature 1..523: note = Synthetic polypeptide
  source 1..523: mol_type = other DNA

SEQ ID NO: 17238 - DNA, 648 bp, synthetic construct; identical to SEQ ID NO: 12806
  misc_feature 1..648: note = Synthetic polypeptide
  source 1..648: mol_type = other DNA

SEQ ID NO: 17239 - DNA, 405 bp, synthetic construct; identical to SEQ ID NO: 12807
  misc_feature 1..405: note = Synthetic polypeptide
  source 1..405: mol_type = other DNA

SEQ ID NO: 17240 - DNA, 627 bp, synthetic construct; identical to SEQ ID NO: 12808
  misc_feature 1..627: note = Synthetic polypeptide
  source 1..627: mol_type = other DNA

SEQ ID NO: 17241 - DNA, 411 bp, synthetic construct; identical to SEQ ID NO: 12809
  misc_feature 1..411: note = Synthetic polypeptide
  source 1..411: mol_type = other DNA

SEQ ID NO: 17242 - DNA, 570 bp, synthetic construct; identical to SEQ ID NO: 12810
  misc_feature 1..570: note = Synthetic polypeptide
  source 1..570: mol_type = other DNA

SEQ ID NO: 17243 - DNA, 434 bp, synthetic construct; identical to SEQ ID NO: 8041
  misc_feature 1..434: note = Synthetic polypeptide
  source 1..434: mol_type = other DNA

SEQ ID NO: 17244 - DNA, 2319 bp, synthetic construct; identical to SEQ ID NO: 6366
  misc_feature 1..2319: note = Synthetic polypeptide
  source 1..2319: mol_type = other DNA

SEQ ID NO: 17245 - DNA, 1573 bp, synthetic construct
  misc_feature 1..1573: note = Synthetic polypeptide
  source 1..1573: mol_type = other DNA
ggatacaaaatcaatgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtga

SEQ ID NO: 17246 - DNA, 543 bp, synthetic construct; identical to SEQ ID NO: 6496
  misc_feature 1..543: note = Synthetic polypeptide
  source 1..543: mol_type = other DNA

SEQ ID NO: 17247 - DNA, 378 bp, synthetic construct; identical to SEQ ID NO: 6497
  misc_feature 1..378: note = Synthetic polypeptide
  source 1..378: mol_type = other DNA

SEQ ID NO: 17248 - DNA, 267 bp, synthetic construct; identical to SEQ ID NO: 6498
  misc_feature 1..267: note = Synthetic polypeptide
  source 1..267: mol_type = other DNA

SEQ ID NO: 17249 - DNA, 416 bp, synthetic construct; identical to SEQ ID NO: 6499
  misc_feature 1..416: note = Synthetic polypeptide
  source 1..416: mol_type = other DNA

SEQ ID NO: 17250 - DNA, 162 bp, synthetic construct; identical to SEQ ID NO: 6500
  misc_feature 1..162: note = Synthetic polypeptide
  source 1..162: mol_type = other DNA

SEQ ID NO: 17251 - DNA, 348 bp, synthetic construct; identical to SEQ ID NO: 6363
  misc_feature 1..348: note = Synthetic polypeptide
  source 1..348: mol_type = other DNA

SEQ ID NO: 17252 - DNA, 299 bp, synthetic construct; identical to SEQ ID NO: 485
  misc_feature 1..299: note = Synthetic polypeptide
  source 1..299: mol_type = other DNA

SEQ ID NO: 17253 - DNA, 790 bp, synthetic construct
  misc_feature 1..790: note = Synthetic polypeptide
  source 1..790: mol_type = other DNA
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactag

SEQ ID NO: 17254 - DNA, 853 bp, synthetic construct
  misc_feature 1..853: note = Synthetic polypeptide
  source 1..853: mol_type = other DNA
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaaggtaggagccaggccagagcacgcacgcactcctagctcactccaacatagcgaagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtga

SEQ ID NO: 17255 - DNA, 490 bp, synthetic construct
  misc_feature 1..490: note = Synthetic polypeptide
  source 1..490: mol_type = other DNA
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagagctacgaagtga

SEQ ID NO: 17256 - DNA, 705 bp, synthetic construct
  misc_feature 1..705: note = Synthetic polypeptide
  source 1..705: mol_type = other DNA
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacc

SEQ ID NO: 17257 - DNA, 759 bp, synthetic construct
  misc_feature 1..759: note = Synthetic polypeptide
  source 1..759: mol_type = other DNA
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggact

SEQ ID NO: 17258 - DNA, 806 bp, synthetic construct
  misc_feature 1..806: note = Synthetic polypeptide
  source 1..806: mol_type = other DNA
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctga

SEQ ID NO: 17259 - DNA, 359 bp, synthetic construct
  misc_feature 1..359: note = Synthetic polypeptide
  source 1..359: mol_type = other DNA
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcacccca

SEQ ID NO: 17260 - DNA, 449 bp, synthetic construct
  misc_feature 1..449: note = Synthetic polypeptide
  source 1..449: mol_type = other DNA
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccgg

SEQ ID NO: 17261 - DNA, 427 bp, synthetic construct; identical to SEQ ID NO: 573
  misc_feature 1..427: note = Synthetic polypeptide
  source 1..427: mol_type = other DNA

SEQ ID NO: 17262 - DNA, 2340 bp, synthetic construct; identical to SEQ ID NO: 14777
  misc_feature 1..2340: note = Synthetic polypeptide
  source 1..2340: mol_type = other DNA

SEQ ID NO: 17263 - DNA, 383 bp, synthetic construct; identical to SEQ ID NO: 14778
  misc_feature 1..383: note = Synthetic polypeptide
  source 1..383: mol_type = other DNA

SEQ ID NO: 17264 - DNA, 473 bp, synthetic construct; identical to SEQ ID NO: 13837
  misc_feature 1..473: note = Synthetic polypeptide
  source 1..473: mol_type = other DNA

SEQ ID NO: 17265 - DNA, 191 bp, synthetic construct; identical to SEQ ID NO: 14798
  misc_feature 1..191: note = Synthetic polypeptide
  source 1..191: mol_type = other DNA

SEQ ID NO: 17266 - DNA, 520 bp, synthetic construct; identical to SEQ ID NO: 6424
  misc_feature 1..520: note = Synthetic polypeptide
  source 1..520: mol_type = other DNA

SEQ ID NO: 17267 - DNA, 96 bp, synthetic construct; identical to SEQ ID NO: 9766
  misc_feature 1..96: note = Synthetic polypeptide
  source 1..96: mol_type = other DNA

SEQ ID NO: 17268 - DNA, 797 bp, synthetic construct; identical to SEQ ID NO: 14879
  misc_feature 1..797: note = Synthetic polypeptide
  source 1..797: mol_type = other DNA

SEQ ID NO: 17269 - DNA, 552 bp, synthetic construct; identical to SEQ ID NO: 14880
  misc_feature 1..552: note = Synthetic polypeptide
  source 1..552: mol_type = other DNA

SEQ ID NO: 17270 - DNA, 819 bp, synthetic construct; identical to SEQ ID NO: 14881
  misc_feature 1..819: note = Synthetic polypeptide
  source 1..819: mol_type = other DNA

SEQ ID NO: 17271 - DNA, 120 bp, synthetic construct; identical to SEQ ID NO: 14806
  misc_feature 1..120: note = Synthetic polypeptide
  source 1..120: mol_type = other DNA

SEQ ID NO: 17272 - DNA, 861 bp, synthetic construct; identical to SEQ ID NO: 16559
  misc_feature 1..861: note = Synthetic polypeptide
  source 1..861: mol_type = other DNA

SEQ ID NO: 17273 - DNA, 616 bp, synthetic construct; identical to SEQ ID NO: 16560
  misc_feature 1..616: note = Synthetic polypeptide
  source 1..616: mol_type = other DNA

SEQ ID NO: 17274 - DNA, 530 bp, synthetic construct; identical to SEQ ID NO: 16561
  misc_feature 1..530: note = Synthetic polypeptide
  source 1..530: mol_type = other DNA

SEQ ID NO: 17275 - DNA, 378 bp, synthetic construct; identical to SEQ ID NO: 16562
  misc_feature 1..378: note = Synthetic polypeptide
  source 1..378: mol_type = other DNA

SEQ ID NO: 17276 - DNA, 2197 bp, synthetic construct
  misc_feature 1..2197: note = Synthetic polypeptide
  source 1..2197: mol_type = other DNA
agcatggactcaggagccagacttcctgagtctgaatcccagccctgcaacataccatctgagcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggcgttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttga

SEQ ID NO: 17277 - DNA, 756 bp, synthetic construct; identical to SEQ ID NO: 8739
  misc_feature 1..756: note = Synthetic polypeptide
  source 1..756: mol_type = other DNA

SEQ ID NO: 17278 - DNA, 871 bp, synthetic construct; identical to SEQ ID NO: 437
  misc_feature 1..871: note = Synthetic polypeptide
  source 1..871: mol_type = other DNA

SEQ ID NO: 17279 - DNA, 421 bp, synthetic construct; identical to SEQ ID NO: 441
  misc_feature 1..421: note = Synthetic polypeptide
  source 1..421: mol_type = other DNA

SEQ ID NO: 17280 - DNA, 638 bp, synthetic construct; identical to SEQ ID NO: 442
  misc_feature 1..638: note = Synthetic polypeptide
  source 1..638: mol_type = other DNA

SEQ ID NO: 17281 - DNA, 337 bp, synthetic construct; identical to SEQ ID NO: 443
  misc_feature 1..337: note = Synthetic polypeptide
  source 1..337: mol_type = other DNA

SEQ ID NO: 17282 - DNA, 1220 bp, synthetic construct; identical to SEQ ID NO: 14932
  misc_feature 1..1220: note = Synthetic polypeptide
  source 1..1220: mol_type = other DNA

SEQ ID NO: 17283 - DNA, 1139 bp, synthetic construct; identical to SEQ ID NO: 14933
  misc_feature 1..1139: note = Synthetic polypeptide
  source 1..1139: mol_type = other DNA

SEQ ID NO: 17284 - DNA, 1160 bp, synthetic construct; identical to SEQ ID NO: 14934
  misc_feature 1..1160: note = Synthetic polypeptide
  source 1..1160: mol_type = other DNA

SEQ ID NO: 17285 - DNA, 409 bp, synthetic construct; identical to SEQ ID NO: 14926
  misc_feature 1..409: note = Synthetic polypeptide
  source 1..409: mol_type = other DNA

SEQ ID NO: 17286 - DNA, 614 bp, synthetic construct; identical to SEQ ID NO: 14952
  misc_feature 1..614: note = Synthetic polypeptide
  source 1..614: mol_type = other DNA

SEQ ID NO: 17287 - DNA, 1631 bp, synthetic construct; identical to SEQ ID NO: 7615
  misc_feature 1..1631: note = Synthetic polypeptide
  source 1..1631: mol_type = other DNA

SEQ ID NO: 17288 - DNA, 1062 bp, synthetic construct; identical to SEQ ID NO: 14892
  misc_feature 1..1062: note = Synthetic polypeptide
  source 1..1062: mol_type = other DNA

SEQ ID NO: 17289 - DNA, 80 bp, synthetic construct; identical to SEQ ID NO: 14893
  misc_feature 1..80: note = Synthetic polypeptide
  source 1..80: mol_type = other DNA

SEQ ID NO: 17290 - DNA, 630 bp, synthetic construct; identical to SEQ ID NO: 14910
  misc_feature 1..630: note = Synthetic polypeptide
  source 1..630: mol_type = other DNA

SEQ ID NO: 17291 - DNA, 360 bp, synthetic construct; identical to SEQ ID NO: 14911
  misc_feature 1..360: note = Synthetic polypeptide
  source 1..360: mol_type = other DNA

SEQ ID NO: 17292 - DNA, 858 bp, synthetic construct; identical to SEQ ID NO: 14912
  misc_feature 1..858: note = Synthetic polypeptide
  source 1..858: mol_type = other DNA

SEQ ID NO: 17293 - DNA, 768 bp, synthetic construct; identical to SEQ ID NO: 14913
  misc_feature 1..768: note = Synthetic polypeptide
  source 1..768: mol_type = other DNA

SEQ ID NO: 17294 - DNA, 428 bp, synthetic construct; identical to SEQ ID NO: 14914
  misc_feature 1..428: note = Synthetic polypeptide
  source 1..428: mol_type = other DNA

SEQ ID NO: 17295 - DNA, 360 bp, synthetic construct; identical to SEQ ID NO: 14809
  misc_feature 1..360: note = Synthetic polypeptide
  source 1..360: mol_type = other DNA

SEQ ID NO: 17296 - DNA, 391 bp, synthetic construct
  misc_feature 1..391: note = Synthetic polypeptide
  source 1..391: mol_type = other DNA
ccagtgttgaaggaggggcctgcagggaggtgtctgggtcatgggggtggatccctcatgagtgacttagtgccacccccttggcgatgagtgtgttcactcagatctggttgttcacaagtgtgtggctcctcctcaccccttgctcccactctcaccatgtggtgtgcctgttcctgcttcgccttccaccgtgaggaaaactccctgagggcctccccagaagctgagcagaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctga

SEQ ID NO: 17297 - DNA, 418 bp, synthetic construct; identical to SEQ ID NO: 14823
  misc_feature 1..418: note = Synthetic polypeptide
  source 1..418: mol_type = other DNA

SEQ ID NO: 17298 - DNA, 1304 bp, synthetic construct; identical to SEQ ID NO: 9787
  misc_feature 1..1304: note = Synthetic polypeptide
  source 1..1304: mol_type = other DNA

SEQ ID NO: 17299 - DNA, 1403 bp, synthetic construct; identical to SEQ ID NO: 9788
  misc_feature 1..1403: note = Synthetic polypeptide
  source 1..1403: mol_type = other DNA

SEQ ID NO: 17300 - DNA, 1355 bp, synthetic construct; identical to SEQ ID NO: 9789
  misc_feature 1..1355: note = Synthetic polypeptide
  source 1..1355: mol_type = other DNA

SEQ ID NO: 17301 - DNA, 322 bp, synthetic construct; identical to SEQ ID NO: 14839
  misc_feature 1..322: note = Synthetic polypeptide
  source 1..322: mol_type = other DNA

SEQ ID NO: 17302 - DNA, 1401 bp, synthetic construct
  misc_feature 1..1401: note = Synthetic polypeptide
  source 1..1401: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 17303 - DNA, 684 bp, synthetic construct
  misc_feature 1..684: note = Synthetic polypeptide
  source 1..684: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtag

SEQ ID NO: 17304 - DNA, 819 bp, synthetic construct
  misc_feature 1..819: note = Synthetic polypeptide
  source 1..819: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtag

SEQ ID NO: 17305 - DNA, 1539 bp, synthetic construct
  misc_feature 1..1539: note = Synthetic polypeptide
  source 1..1539: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcaggttcaggaggaaatgggctcagccttcccggttcttccaggaggctccactggctggggggctttgcagatgtttgggaggaccacacccagtcctgagggaggcagcagacagacatggatggagtgctggtgctcgaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 17306 - DNA, 462 bp, synthetic construct
  misc_feature 1..462: note = Synthetic polypeptide
  source 1..462: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttgggatgctcccatttcccagtagcctccaggcctgcaggttcccatga

SEQ ID NO: 17307 - DNA, 816 bp, synthetic construct
  misc_feature 1..816: note = Synthetic polypeptide
  source 1..816: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggcc

SEQ ID NO: 17308 - DNA, 597 bp, synthetic construct
  misc_feature 1..597: note = Synthetic polypeptide
  source 1..597: mol_type = other DNA
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctgggatgctcccatttcccagtagcctccaggcctgcaggttcccatga

SEQ ID NO: 17309 - DNA, 1067 bp, synthetic construct; identical to SEQ ID NO: 9936
  misc_feature 1..1067: note = Synthetic polypeptide
  source 1..1067: mol_type = other DNA

SEQ ID NO: 17310 - DNA, 968 bp, synthetic construct; identical to SEQ ID NO: 9937
  misc_feature 1..968: note = Synthetic polypeptide
  source 1..968: mol_type = other DNA

SEQ ID NO: 17311 - DNA, 1516 bp, synthetic construct; identical to SEQ ID NO: 534
  misc_feature 1..1516: note = Synthetic polypeptide
  source 1..1516: mol_type = other DNA

SEQ ID NO: 17312 - DNA, 591 bp, synthetic construct; identical to SEQ ID NO: 539
  misc_feature 1..591: note = Synthetic polypeptide
  source 1..591: mol_type = other DNA

SEQ ID NO: 17313 - DNA, 482 bp, synthetic construct; identical to SEQ ID NO: 540
  misc_feature 1..482: note = Synthetic polypeptide
  source 1..482: mol_type = other DNA

SEQ ID NO: 17314 - DNA, 444 bp, synthetic construct; identical to SEQ ID NO: 541
  misc_feature 1..444: note = Synthetic polypeptide
  source 1..444: mol_type = other DNA

SEQ ID NO: 17315 - DNA, 334 bp, synthetic construct; identical to SEQ ID NO: 533
  misc_feature 1..334: note = Synthetic polypeptide
  source 1..334: mol_type = other DNA

SEQ ID NO: 17316 - DNA, 38 bp, synthetic construct; identical to SEQ ID NO: 543
  misc_feature 1..38: note = Synthetic polypeptide
  source 1..38: mol_type = other DNA

SEQ ID NO: 17317 - DNA, 245 bp, synthetic construct; identical to SEQ ID NO: 542
  misc_feature 1..245: note = Synthetic polypeptide
  source 1..245: mol_type = other DNA

SEQ ID NO: 17318 - DNA, 1227 bp, synthetic construct; identical to SEQ ID NO: 10479
  misc_feature 1..1227: note = Synthetic polypeptide
  source 1..1227: mol_type = other DNA

SEQ ID NO: 17319 - DNA, 1299 bp, synthetic construct
  misc_feature 1..1299: note = Synthetic polypeptide
  source 1..1299: mol_type = other DNA
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactga

SEQ ID NO: 17320 - DNA, 189 bp, synthetic construct
  misc_feature 1..189: note = Synthetic polypeptide
  source 1..189: mol_type = other DNA
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgtgctcttctgcatttttaattag

SEQ ID NO: 17321 - DNA, 480 bp, synthetic construct
  misc_feature 1..480: note = Synthetic polypeptide
  source 1..480: mol_type = other DNA
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctga

SEQ ID NO: 17322 - DNA, 218 bp, synthetic construct
  misc_feature 1..218: note = Synthetic polypeptide
  source 1..218: mol_type = other DNA
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgggatggtaggatgctctttgactacctggcggacaagcatggttttaggcag

SEQ ID NO: 17323 - DNA, 2073 bp, synthetic construct; identical to SEQ ID NO: 14983
  misc_feature 1..2073: note = Synthetic polypeptide
  source 1..2073: mol_type = other DNA

SEQ ID NO: 17324 - DNA, 1708 bp, synthetic construct; identical to SEQ ID NO: 14810
  misc_feature 1..1708: note = Synthetic polypeptide
  source 1..1708: mol_type = other DNA

SEQ ID NO: 17325 - DNA, 1687 bp, synthetic construct; identical to SEQ ID NO: 14811
  misc_feature 1..1687: note = Synthetic polypeptide
  source 1..1687: mol_type = other DNA

SEQ ID NO: 17326 - DNA, 685 bp, synthetic construct; identical to SEQ ID NO: 14812
  misc_feature 1..685: note = Synthetic polypeptide
  source 1..685: mol_type = other DNA

SEQ ID NO: 17327 - DNA, 589 bp, synthetic construct; identical to SEQ ID NO: 14813
  misc_feature 1..589: note = Synthetic polypeptide
  source 1..589: mol_type = other DNA

SEQ ID NO: 17328 - DNA, 733 bp, synthetic construct; identical to SEQ ID NO: 14814
  misc_feature 1..733: note = Synthetic polypeptide
  source 1..733: mol_type = other DNA

SEQ ID NO: 17329 - DNA, 745 bp, synthetic construct; identical to SEQ ID NO: 14815
  misc_feature 1..745: note = Synthetic polypeptide
  source 1..745: mol_type = other DNA

SEQ ID NO: 17330 - DNA, 154 bp, synthetic construct; identical to SEQ ID NO: 14816
  misc_feature 1..154: note = Synthetic polypeptide
  source 1..154: mol_type = other DNA

SEQ ID NO: 17331 - DNA, 96 bp, synthetic construct; identical to SEQ ID NO: 14817
  misc_feature 1..96: note = Synthetic polypeptide
  source 1..96: mol_type = other DNA

SEQ ID NO: 17332 - DNA, 2825 bp, synthetic construct; identical to SEQ ID NO: 14951
  misc_feature 1..2825: note = Synthetic polypeptide
  source 1..2825: mol_type = other DNA

SEQ ID NO: 17333 - DNA, 2477 bp, synthetic construct; identical to SEQ ID NO: 14819
  misc_feature 1..2477: note = Synthetic polypeptide
  source 1..2477: mol_type = other DNA

SEQ ID NO: 17334 - DNA, 1101 bp, synthetic construct; identical to SEQ ID NO: 8142
  misc_feature 1..1101: note = Synthetic polypeptide
  source 1..1101: mol_type = other DNA

SEQ ID NO: 17335 - DNA, 1896 bp, synthetic construct; identical to SEQ ID NO: 8143
  misc_feature 1..1896: note = Synthetic polypeptide
  source 1..1896: mol_type = other DNA

SEQ ID NO: 17336 - DNA, 1662 bp, synthetic construct; identical to SEQ ID NO: 8144
  misc_feature 1..1662: note = Synthetic polypeptide
  source 1..1662: mol_type = other DNA

SEQ ID NO: 17337 - DNA, 405 bp, synthetic construct; identical to SEQ ID NO: 7860
  misc_feature 1..405: note = Synthetic polypeptide
  source 1..405: mol_type = other DNA

SEQ ID NO: 17338 - DNA, 274 bp, synthetic construct; identical to SEQ ID NO: 7861
  misc_feature 1..274: note = Synthetic polypeptide
  source 1..274: mol_type = other DNA

SEQ ID NO: 17339 - DNA, 196 bp, synthetic construct; identical to SEQ ID NO: 7862
  misc_feature 1..196: note = Synthetic polypeptide
  source 1..196: mol_type = other DNA

SEQ ID NO: 17340 - DNA, 268 bp, synthetic construct; identical to SEQ ID NO: 7863
  misc_feature 1..268: note = Synthetic polypeptide
  source 1..268: mol_type = other DNA

SEQ ID NO: 17341 - DNA, 186 bp, synthetic construct; identical to SEQ ID NO: 7864
  misc_feature 1..186: note = Synthetic polypeptide
  source 1..186: mol_type = other DNA

SEQ ID NO: 17342 - DNA, 1646 bp, synthetic construct
  misc_feature 1..1646: note = Synthetic polypeptide
  source 1..1646: mol_type = other DNA
tttcctggttccctgactgggaagtgaggtgattggtggatggtcgaggcagctccttaggtgacttaagcctgccctgtggaacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 17343 - DNA, 757 bp, synthetic construct; identical to SEQ ID NO: 14961
  misc_feature 1..757: note = Synthetic polypeptide
  source 1..757: mol_type = other DNA

SEQ ID NO: 17344 - DNA, 622 bp, synthetic construct; identical to SEQ ID NO: 14962
  misc_feature 1..622: note = Synthetic polypeptide
  source 1..622: mol_type = other DNA

SEQ ID NO: 17345 - DNA, 340 bp, synthetic construct; identical to SEQ ID NO: 14963
  misc_feature 1..340: note = Synthetic polypeptide
  source 1..340: mol_type = other DNA

SEQ ID NO: 17346 - DNA, 187 bp, synthetic construct; identical to SEQ ID NO: 14964
  misc_feature 1..187: note = Synthetic polypeptide
  source 1..187: mol_type = other DNA

SEQ ID NO: 17347 - DNA, 1435 bp, synthetic construct; identical to SEQ ID NO: 14131
  misc_feature 1..1435: note = Synthetic polypeptide
  source 1..1435: mol_type = other DNA

SEQ ID NO: 17348 - DNA, 340 bp, synthetic construct; identical to SEQ ID NO: 14132
  misc_feature 1..340: note = Synthetic polypeptide
  source 1..340: mol_type = other DNA

SEQ ID NO: 17349 - DNA, 964 bp, synthetic construct; identical to SEQ ID NO: 15050
  misc_feature 1..964: note = Synthetic polypeptide
  source 1..964: mol_type = other DNA

SEQ ID NO: 17350 - DNA, 355 bp, synthetic construct; identical to SEQ ID NO: 8039
  misc_feature 1..355: note = Synthetic polypeptide
  source 1..355: mol_type = other DNA

SEQ ID NO: 17351 - DNA, 2356 bp, synthetic construct; identical to SEQ ID NO: 10008
  misc_feature 1..2356: note = Synthetic polypeptide
  source 1..2356: mol_type = other DNA

SEQ ID NO: 17352 - DNA, 871 bp, synthetic construct; identical to SEQ ID NO: 10009
  misc_feature 1..871: note = Synthetic polypeptide
  source 1..871: mol_type = other DNA

SEQ ID NO: 17353 - DNA, 2470 bp, synthetic construct; identical to SEQ ID NO: 10010
  misc_feature 1..2470: note = Synthetic polypeptide
  source 1..2470: mol_type = other DNA

SEQ ID NO: 17354 - DNA, 1244 bp, synthetic construct
  misc_feature 1..1244: note = Synthetic polypeptide
  source 1..1244: mol_type = other DNA
gccaggcacagcagctcatgcctgtcatctcagcactttgggagaccgaggcaggcggatcacctgaggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccaccgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctga

SEQ ID NO: 17355 - DNA, 479 bp, synthetic construct
  misc_feature 1..479: note = Synthetic polypeptide
  source 1..479: mol_type = other DNA
gccaggcacagcagctcatgcctgtcatctcagcactttgggagaccgaggcaggcggatcacctgaggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtga

SEQ ID NO: 17356 - DNA, 411 bp, synthetic construct
  misc_feature 1..411: note = Synthetic polypeptide
  source 1..411: mol_type = other DNA
ggccggcgcggtgactcaggcctgtaatcccagcactttgggaggccgagctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactga

SEQ ID NO: 17357 - DNA, 282 bp, synthetic construct; identical to SEQ ID NO: 7621
  misc_feature 1..282: note = Synthetic polypeptide
  source 1..282: mol_type = other DNA

SEQ ID NO: 17358 - DNA, 452 bp, synthetic construct
  misc_feature 1..452: note = Synthetic polypeptide
  source 1..452: mol_type = other DNA
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaa

SEQ ID NO: 17359 - DNA, 518 bp, synthetic construct
  misc_feature 1..518: note = Synthetic polypeptide
  source 1..518: mol_type = other DNA
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccatggagtctccctctgttgcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatga

SEQ ID NO: 17360 - DNA, 188 bp, synthetic construct
  misc_feature 1..188: note = Synthetic polypeptide
  source 1..188: mol_type = other DNA
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtga

SEQ ID NO: 17361 - DNA, 1047 bp, synthetic construct; identical to SEQ ID NO: 8738
  misc_feature 1..1047: note = Synthetic polypeptide
  source 1..1047: mol_type = other DNA

SEQ ID NO: 17362 - DNA, 711 bp, synthetic construct
  misc_feature 1..711: note = Synthetic polypeptide
  source 1..711: mol_type = other DNA
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17363 - DNA, 501 bp, synthetic construct
  misc_feature 1..501: note = Synthetic polypeptide
  source 1..501: mol_type = other DNA
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 17364 - DNA, 681 bp, synthetic construct
  misc_feature 1..681: note = Synthetic polypeptide
  source 1..681: mol_type = other DNA
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17365 - DNA, 876 bp, synthetic construct
  misc_feature 1..876: note = Synthetic polypeptide
  source 1..876: mol_type = other DNA
gggcgcggtggcttacatgtggaatcccaacactttgggaggctgaggcaggaagatcacctgaggtcaggagttcgagaccagcctgaccaaaatggagaaaccccatctctactgaaaatacaaaattagccgggcgtggtggtgcatgcctgtaatcctagctactcgggaggctgaggcaggagaattgcttgaacctgggaggcagaggttgcgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcatag

SEQ ID NO: 17366 - DNA, 1342 bp, synthetic construct; identical to SEQ ID NO: 10636
  misc_feature 1..1342: note = Synthetic polypeptide
  source 1..1342: mol_type = other DNA

SEQ ID NO: 17367 - DNA, 1231 bp, synthetic construct; identical to SEQ ID NO: 10637
  misc_feature 1..1231: note = Synthetic polypeptide
  source 1..1231: mol_type = other DNA

SEQ ID NO: 17368 - DNA, 145 bp, synthetic construct; identical to SEQ ID NO: 10638
  misc_feature 1..145: note = Synthetic polypeptide
  source 1..145: mol_type = other DNA

SEQ ID NO: 17369 - DNA, 1441 bp, synthetic construct; identical to SEQ ID NO: 10639
  misc_feature 1..1441: note = Synthetic polypeptide
  source 1..1441: mol_type = other DNA

SEQ ID NO: 17370 - DNA, 384 bp, synthetic construct; identical to SEQ ID NO: 10640
  misc_feature 1..384: note = Synthetic polypeptide
  source 1..384: mol_type = other DNA

SEQ ID NO: 17371 - DNA, 665 bp, synthetic construct; identical to SEQ ID NO: 6374
  misc_feature 1..665: note = Synthetic polypeptide
  source 1..665: mol_type = other DNA

SEQ ID NO: 17372 - DNA, 518 bp, synthetic construct; identical to SEQ ID NO: 6375
  misc_feature 1..518: note = Synthetic polypeptide
  source 1..518: mol_type = other DNA

SEQ ID NO: 17373 - DNA, 153 bp, synthetic construct
  misc_feature 1..153: note = Synthetic polypeptide
  source 1..153: mol_type = other DNA
gccagaattccagtgccagctccactcctcacgagctgtacaacctgggccggttactgacccctttcccaccttagttccctggctctacaatggaggtggcccgaggcagccgggatgacagctctccccaggaatcctgctgcctgctga

SEQ ID NO: 17374 - DNA, 1532 bp, synthetic construct; identical to SEQ ID NO: 14790
  misc_feature 1..1532: note = Synthetic polypeptide
  source 1..1532: mol_type = other DNA

SEQ ID NO: 17375 - DNA, 1466 bp, synthetic construct; identical to SEQ ID NO: 14791
  misc_feature 1..1466: note = Synthetic polypeptide
  source 1..1466: mol_type = other DNA

SEQ ID NO: 17376 - DNA, 139 bp, synthetic construct; identical to SEQ ID NO: 8939
  misc_feature 1..139: note = Synthetic polypeptide
  source 1..139: mol_type = other DNA

SEQ ID NO: 17377 - DNA, 368 bp, synthetic construct; identical to SEQ ID NO: 8940
  misc_feature 1..368: note = Synthetic polypeptide
  source 1..368: mol_type = other DNA

SEQ ID NO: 17378 - DNA, 2192 bp, synthetic construct; identical to SEQ ID NO: 8941
  misc_feature 1..2192: note = Synthetic polypeptide
  source 1..2192: mol_type = other DNA

SEQ ID NO: 17379 - DNA, 1328 bp, synthetic construct; identical to SEQ ID NO: 8942
  misc_feature 1..1328: note = Synthetic polypeptide
  source 1..1328: mol_type = other DNA

SEQ ID NO: 17380 - DNA, 2117 bp, synthetic construct; identical to SEQ ID NO: 8943
  misc_feature 1..2117: note = Synthetic polypeptide
  source 1..2117: mol_type = other DNA

SEQ ID NO: 17381 - DNA, 1265 bp, synthetic construct; identical to SEQ ID NO: 8944
  misc_feature 1..1265: note = Synthetic polypeptide
  source 1..1265: mol_type = other DNA

SEQ ID NO: 17382 - DNA, 1331 bp, synthetic construct; identical to SEQ ID NO: 8945
  misc_feature 1..1331: note = Synthetic polypeptide
  source 1..1331: mol_type = other DNA

SEQ ID NO: 17383 - DNA, 153 bp, synthetic construct
  misc_feature 1..153: note = Synthetic polypeptide
  source 1..153: mol_type = other DNA
gccagaattccagtgccagctccgctcctcacgagctgtacaacctgggccggttactgacccctttcccaccttagttccctggctctacaatggaggtggcccgaggcagccgggatgacagctctccccaggaatcctgctgcctgctga

SEQ ID NO: 17384 - DNA, 1720 bp, synthetic construct
  misc_feature 1..1720: note = Synthetic polypeptide
  source 1..1720: mol_type = other DNA
tgatgtggtttggctctgtgtccccacccagatctcatcttgaataccatctcccagatttcccacatgttgtgggagggacccagggggaggtaattgaatcatgggggctggtctttcccatgctattctcgtgatagtgaataagtctcacgagatctgataggcttatcaggggtttccgcttttgctgctgcttcatttttctgttgctgccgccatgtgagaagtgtctttcacctcccgccatgattctgaggcctccccagccatgtggaactaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtag

SEQ ID NO: 17385 - DNA, 2051 bp, synthetic construct; identical to SEQ ID NO: 14965
  misc_feature 1..2051: note = Synthetic polypeptide
  source 1..2051: mol_type = other DNA

SEQ ID NO: 17386 - DNA, 2030 bp, synthetic construct; identical to SEQ ID NO: 14966
  misc_feature 1..2030: note = Synthetic polypeptide
  source 1..2030: mol_type = other DNA

SEQ ID NO: 17387 - DNA, 2051 bp, synthetic construct; identical to SEQ ID NO: 14967
  misc_feature 1..2051: note = Synthetic polypeptide
  source 1..2051: mol_type = other DNA

SEQ ID NO: 17388 - DNA, 1925 bp, synthetic construct; identical to SEQ ID NO: 14968
  misc_feature 1..1925: note = Synthetic polypeptide
  source 1..1925: mol_type = other DNA

SEQ ID NO: 17389 - DNA, 932 bp, synthetic construct; identical to SEQ ID NO: 14969
  misc_feature 1..932: note = Synthetic polypeptide
  source 1..932: mol_type = other DNA

SEQ ID NO: 17390 - DNA, 1076 bp, synthetic construct; identical to SEQ ID NO: 14970
  misc_feature 1..1076: note = Synthetic polypeptide
  source 1..1076: mol_type = other DNA

SEQ ID NO: 17391 - DNA, 941 bp, synthetic construct; identical to SEQ ID NO: 14971
  misc_feature 1..941: note = Synthetic polypeptide
  source 1..941: mol_type = other DNA

SEQ ID NO: 17392 - DNA, 497 bp, synthetic construct; identical to SEQ ID NO: 14972
  misc_feature 1..497: note = Synthetic polypeptide
  source 1..497: mol_type = other DNA

SEQ ID NO: 17393 - DNA, 439 bp, synthetic construct; identical to SEQ ID NO: 14973
  misc_feature 1..439: note = Synthetic polypeptide
  source 1..439: mol_type = other DNA

SEQ ID NO: 17394 - DNA, 751 bp, synthetic construct
  misc_feature 1..751: note = Synthetic polypeptide
  source 1..751: mol_type = other DNA
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17395 - DNA, 541 bp, synthetic construct
  misc_feature 1..541: note = Synthetic polypeptide
  source 1..541: mol_type = other DNA
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 17396 - DNA, 721 bp, synthetic construct
  misc_feature 1..721: note = Synthetic polypeptide
  source 1..721: mol_type = other DNA
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17397 - DNA, 434 bp, synthetic construct; identical to SEQ ID NO: 8041
  misc_feature 1..434: note = Synthetic polypeptide
  source 1..434: mol_type = other DNA

SEQ ID NO: 17398 - DNA, 768 bp, synthetic construct
  misc_feature 1..768: note = Synthetic polypeptide
  source 1..768: mol_type = other DNA
gccgggccgcgccgccgctgccgccgccgcgcgcggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctga

SEQ ID NO: 17399 - DNA, 597 bp, synthetic construct
  misc_feature 1..597: note = Synthetic polypeptide
  source 1..597: mol_type = other DNA
gccgggccgcgccgccgctgccgccgccgcgcgcggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctga

SEQ ID NO: 17400 - DNA, 271 bp, synthetic construct
  misc_feature 1..271: note = Synthetic polypeptide
  source 1..271: mol_type = other DNA
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaa

SEQ ID NO: 17401 - DNA, 271 bp, synthetic construct
  misc_feature 1..271: note = Synthetic polypeptide
  source 1..271: mol_type = other DNA
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgatgaaggagtggccccaaccaatgtga

SEQ ID NO: 17402 - DNA, 259 bp, synthetic construct
  misc_feature 1..259: note = Synthetic polypeptide
  source 1..259: mol_type = other DNA
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgtcaccgtcccaatga

SEQ ID NO: 17403 - DNA, 67 bp, synthetic construct; identical to SEQ ID NO: 16124
  misc_feature 1..67: note = Synthetic polypeptide
  source 1..67: mol_type = other DNA

SEQ ID NO: 17404 - DNA, 807 bp, synthetic construct; identical to SEQ ID NO: 7401
  misc_feature 1..807: note = Synthetic polypeptide
  source 1..807: mol_type = other DNA

SEQ ID NO: 17405 - DNA, 453 bp, synthetic construct; identical to SEQ ID NO: 7402
  misc_feature 1..453: note = Synthetic polypeptide
  source 1..453: mol_type = other DNA

SEQ ID NO: 17406 - DNA, 812 bp, synthetic construct; identical to SEQ ID NO: 693
  misc_feature 1..812: note = Synthetic polypeptide
  source 1..812: mol_type = other DNA

SEQ ID NO: 17407 - DNA, 752 bp, synthetic construct; identical to SEQ ID NO: 694
  misc_feature 1..752: note = Synthetic polypeptide
  source 1..752: mol_type = other DNA

SEQ ID NO: 17408 - DNA, 2104 bp, synthetic construct; identical to SEQ ID NO: 9015
  misc_feature 1..2104: note = Synthetic polypeptide
  source 1..2104: mol_type = other DNA

SEQ ID NO: 17409 - DNA, 333 bp, synthetic construct; identical to SEQ ID NO: 6583
  misc_feature 1..333: note = Synthetic polypeptide
  source 1..333: mol_type = other DNA

SEQ ID NO: 17410 - DNA, 309 bp, synthetic construct; identical to SEQ ID NO: 7876
  misc_feature 1..309: note = Synthetic polypeptide
  source 1..309: mol_type = other DNA

SEQ ID NO: 17411 - DNA, 804 bp, synthetic construct
  misc_feature 1..804: note = Synthetic polypeptide
  source 1..804: mol_type = other DNA
gctcatgcctgtaatcccagcacttcgggaagattgcttgagcccaggagtttgagaccagcctgggcaatatagtgagagtttgtcttcacaaaaaatattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaa

SEQ ID NO: 17412 - DNA, 451 bp, synthetic construct
  misc_feature 1..451: note = Synthetic polypeptide
  source 1..451: mol_type = other DNA
gctcatgcctgtaatcccagcacttcgggaagattgcttgagcccaggagtttgagaccagcctgggcaatatagtgagagtttgtcttcacaaaaaatattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattcc

SEQ ID NO: 17413 - DNA, 769 bp, synthetic construct; identical to SEQ ID NO: 6486
  misc_feature 1..769: note = Synthetic polypeptide
  source 1..769: mol_type = other DNA

SEQ ID NO: 17414 - DNA, 678 bp, synthetic construct; identical to SEQ ID NO: 8918
  misc_feature 1..678: note = Synthetic polypeptide
  source 1..678: mol_type = other DNA

SEQ ID NO: 17415 - DNA, 726 bp, synthetic construct; identical to SEQ ID NO: 8919
  misc_feature 1..726: note = Synthetic polypeptide
  source 1..726: mol_type = other DNA

SEQ ID NO: 17416 - DNA, 1018 bp, synthetic construct
  misc_feature 1..1018: note = Synthetic polypeptide
  source 1..1018: mol_type = other DNA
ctcacacctgtaaacccagcactttgggaggccaagatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtga

SEQ ID NO: 17417 - DNA, 104 bp, synthetic construct
  misc_feature 1..104: note = Synthetic polypeptide
  source 1..104: mol_type = other DNA
ctcacacctgtaaacccagcactttgggaggccaagatttggacgcatcggtcgcctggtcctgcgcgcctgcatggagaagggtgttaaggtggtggctgtga

SEQ ID NO: 17418 - DNA, 532 bp, synthetic construct
  misc_feature 1..532: note = Synthetic polypeptide
  source 1..532: mol_type = other DNA
ctcacacctgtaaacccagcactttgggaggccaagatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatg

SEQ ID NO: 17419 - DNA, 1397 bp, synthetic construct; identical to SEQ ID NO: 14804
  misc_feature 1..1397: note = Synthetic polypeptide
  source 1..1397: mol_type = other DNA

SEQ ID NO: 17420 - DNA, 1331 bp, synthetic construct; identical to SEQ ID NO: 14805
  misc_feature 1..1331: note = Synthetic polypeptide
  source 1..1331: mol_type = other DNA

SEQ ID NO: 17421 - DNA, 6602 bp, synthetic construct; identical to SEQ ID NO: 14996
  misc_feature 1..6602: note = Synthetic polypeptide
  source 1..6602: mol_type = other DNA

SEQ ID NO: 17422 - DNA, 5960 bp, synthetic construct; identical to SEQ ID NO: 14997
  misc_feature 1..5960: note = Synthetic polypeptide
  source 1..5960: mol_type = other DNA

SEQ ID NO: 17423 - DNA, 3305 bp, synthetic construct; identical to SEQ ID NO: 14998
  misc_feature 1..3305: note = Synthetic polypeptide
  source 1..3305: mol_type = other DNA

SEQ ID NO: 17424 - DNA, 2693 bp, synthetic construct; identical to SEQ ID NO: 14999
  misc_feature 1..2693: note = Synthetic polypeptide
  source 1..2693: mol_type = other DNA

SEQ ID NO: 17425 - DNA, 2201 bp, synthetic construct; identical to SEQ ID NO: 15000
  misc_feature 1..2201: note = Synthetic polypeptide
  source 1..2201: mol_type = other DNA

SEQ ID NO: 17426 - DNA, 1325 bp, synthetic construct; identical to SEQ ID NO: 7686
  misc_feature 1..1325: note = Synthetic polypeptide
  source 1..1325: mol_type = other DNA

SEQ ID NO: 17427 - DNA, 1691 bp, synthetic construct; identical to SEQ ID NO: 7687
  misc_feature 1..1691: note = Synthetic polypeptide
  source 1..1691: mol_type = other DNA

SEQ ID NO: 17428 - DNA, 1541 bp, synthetic construct; identical to SEQ ID NO: 7688
  misc_feature 1..1541: note = Synthetic polypeptide
  source 1..1541: mol_type = other DNA

SEQ ID NO: 17429 - DNA, 356 bp, synthetic construct
  misc_feature 1..356: note = Synthetic polypeptide
  source 1..356: mol_type = other DNA
ggaaccttaatgaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17430 - DNA, 382 bp, synthetic construct; identical to SEQ ID NO: 434
  misc_feature 1..382: note = Synthetic polypeptide
  source 1..382: mol_type = other DNA

SEQ ID NO: 17431 - DNA, 1029 bp, synthetic construct; identical to SEQ ID NO: 8732
  misc_feature 1..1029: note = Synthetic polypeptide
  source 1..1029: mol_type = other DNA

SEQ ID NO: 17432 - DNA, 1170 bp, synthetic construct; identical to SEQ ID NO: 8733
  misc_feature 1..1170: note = Synthetic polypeptide
  source 1..1170: mol_type = other DNA

SEQ ID NO: 17433 - DNA, 1062 bp, synthetic construct; identical to SEQ ID NO: 8734
  misc_feature 1..1062: note = Synthetic polypeptide
  source 1..1062: mol_type = other DNA

SEQ ID NO: 17434 - DNA, 573 bp, synthetic construct; identical to SEQ ID NO: 8735
  misc_feature 1..573: note = Synthetic polypeptide
  source 1..573: mol_type = other DNA

SEQ ID NO: 17435 - DNA, 299 bp, synthetic construct; identical to SEQ ID NO: 8736
  misc_feature 1..299: note = Synthetic polypeptide
  source 1..299: mol_type = other DNA

SEQ ID NO: 17436 - DNA, 330 bp, synthetic construct; identical to SEQ ID NO: 6490
  misc_feature 1..330: note = Synthetic polypeptide
  source 1..330: mol_type = other DNA

SEQ ID NO: 17437 - DNA, 653 bp, synthetic construct
  misc_feature 1..653: note = Synthetic polypeptide
  source 1..653: mol_type = other DNA
tctggagctagctagcggccaggactccagttccactctgcttattagcgaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactga

SEQ ID NO: 17438 - DNA, 666 bp, synthetic construct; identical to SEQ ID NO: 15049
  misc_feature 1..666: note = Synthetic polypeptide
  source 1..666: mol_type = other DNA

SEQ ID NO: 17439 - DNA, 449 bp, synthetic construct
  misc_feature 1..449: note = Synthetic polypeptide
  source 1..449: mol_type = other DNA
aaattggagtttcactgaagaataagaaactcactcaaaaccacacaactacatggaaattgaacaaccttctcctgaatgactcctgggtaaataatgaaatcaaggcagaaatcaagaagttctttgaaaccaaagagaacaaagaaaacctctgggatgcagctaaagcagtgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 17440 - DNA, 404 bp, synthetic construct; identical to SEQ ID NO: 6813
  misc_feature 1..404: note = Synthetic polypeptide
  source 1..404: mol_type = other DNA

SEQ ID NO: 17441 - DNA, 417 bp, synthetic construct; identical to SEQ ID NO: 6814
  misc_feature 1..417: note = Synthetic polypeptide
  source 1..417: mol_type = other DNA

SEQ ID NO: 17442 - DNA, 485 bp, synthetic construct; identical to SEQ ID NO: 6815
  misc_feature 1..485: note = Synthetic polypeptide
  source 1..485: mol_type = other DNA

SEQ ID NO: 17443 - DNA, 1745 bp, synthetic construct; identical to SEQ ID NO: 6816
  misc_feature 1..1745: note = Synthetic polypeptide
  source 1..1745: mol_type = other DNA

SEQ ID NO: 17444 - DNA, 1432 bp, synthetic construct; identical to SEQ ID NO: 14897
  misc_feature 1..1432: note = Synthetic polypeptide
  source 1..1432: mol_type = other DNA

SEQ ID NO: 17445 - DNA, 1618 bp, synthetic construct; identical to SEQ ID NO: 14898
  misc_feature 1..1618: note = Synthetic polypeptide
  source 1..1618: mol_type = other DNA

SEQ ID NO: 17446 - DNA, 1708 bp, synthetic construct; identical to SEQ ID NO: 14899
  misc_feature 1..1708: note = Synthetic polypeptide
  source 1..1708: mol_type = other DNA

SEQ ID NO: 17447 - DNA, 1558 bp, synthetic construct; identical to SEQ ID NO: 14900
  misc_feature 1..1558: note = Synthetic polypeptide
  source 1..1558: mol_type = other DNA

SEQ ID NO: 17448 - DNA, 1774 bp, synthetic construct; identical to SEQ ID NO: 14901
  misc_feature 1..1774: note = Synthetic polypeptide
  source 1..1774: mol_type = other DNA

SEQ ID NO: 17449 - DNA, 508 bp, synthetic construct; identical to SEQ ID NO: 14902
  misc_feature 1..508: note = Synthetic polypeptide
  source 1..508: mol_type = other DNA

SEQ ID NO: 17450 - DNA, 418 bp, synthetic construct; identical to SEQ ID NO: 11223
  misc_feature 1..418: note = Synthetic polypeptide
  source 1..418: mol_type = other DNA

SEQ ID NO: 17451 - DNA, 418 bp, synthetic construct; identical to SEQ ID NO: 11223
  misc_feature 1..418: note = Synthetic polypeptide
  source 1..418: mol_type = other DNA

SEQ ID NO: 17452 - DNA, 418 bp, synthetic construct; identical to SEQ ID NO: 11223
  misc_feature 1..418: note = Synthetic polypeptide
  source 1..418: mol_type = other DNA

SEQ ID NO: 17453 - DNA, 386 bp, synthetic construct; identical to SEQ ID NO: 11224
  misc_feature 1..386: note = Synthetic polypeptide
  source 1..386: mol_type = other DNA

SEQ ID NO: 17454 - DNA, 418 bp, synthetic construct; identical to SEQ ID NO: 11223
  misc_feature 1..418: note = Synthetic polypeptide
  source 1..418: mol_type = other DNA

SEQ ID NO: 17455 - DNA, 457 bp, synthetic construct; identical to SEQ ID NO: 11225
  misc_feature 1..457: note = Synthetic polypeptide
  source 1..457: mol_type = other DNA

SEQ ID NO: 17456 - DNA, 496 bp, synthetic construct; identical to SEQ ID NO: 11226
  misc_feature 1..496: note = Synthetic polypeptide
  source 1..496: mol_type = other DNA

SEQ ID NO: 17457 - DNA, 1262 bp, synthetic construct
  misc_feature 1..1262: note = Synthetic polypeptide
  source 1..1262: mol_type = other DNA
ggctgctcgcggtgactcacgcttgtaatcccagcactttgggaggccaaggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 17458 - DNA, 1217 bp, synthetic construct
  misc_feature 1..1217: note = Synthetic polypeptide
  source 1..1217: mol_type = other DNA
ggctgctcgcggtgactcacgcttgtaatcccagcactttgggaggccaaggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 17459 - DNA, 385 bp, synthetic construct; identical to SEQ ID NO: 11229
  misc_feature 1..385: note = Synthetic polypeptide
  source 1..385: mol_type = other DNA

SEQ ID NO: 17460 - DNA, 418 bp, synthetic construct; identical to SEQ ID NO: 11223
  misc_feature 1..418: note = Synthetic polypeptide
  source 1..418: mol_type = other DNA

SEQ ID NO: 17461 - DNA, 385 bp, synthetic construct; identical to SEQ ID NO: 11229
  misc_feature 1..385: note = Synthetic polypeptide
  source 1..385: mol_type = other DNA

SEQ ID NO: 17462 - DNA, 418 bp, synthetic construct; identical to SEQ ID NO: 11223
  misc_feature 1..418: note = Synthetic polypeptide
  source 1..418: mol_type = other DNA

SEQ ID NO: 17463 - DNA, 385 bp, synthetic construct; identical to SEQ ID NO: 11229
  misc_feature 1..385: note = Synthetic polypeptide
  source 1..385: mol_type = other DNA

SEQ ID NO: 17464 - DNA, 1653 bp, synthetic construct
  misc_feature 1..1653: note = Synthetic polypeptide
  source 1..1653: mol_type = other DNA
gaaataatccctaagtacctttacctcctcctttagtaaagcctgttcagcacaggggaacacacccaggtgaagattggcaaatagactacactcaaatacccccatgggaaggattcaaatatttattagtattcatcgatacctttacttgttggattgaagcttttcctacctggtctgaaaaggcaactgacatttctaaatttttattaaaggaaataatccctaagtttgggctgcctaaaagcttacagaatggctcatttttcacagcaacaagaacccaaaatatatcaccggctctaggaattcagtatcatctttattcagcatggaggccacagtttgcaggaaaagtagaaagggccaaacttcaaagaggactcttgccaagttatgccaggaaacatcagaaacctattcgtctctattgcctgtggccttgttgctagttttggctgcccctaagggaaacttgcagctcagctctttcgaaataatgtatggaagtcctttcttaactgcagatttcctagtagatatagatactttcaaattacagaactacgttattaacttaggtcgggtgcaaaaagctcttcttgaatatggaaatcagagacttcctccctccactaaggaagaaaatgctacaatccagccaggaaactgggttctattaaaaacttggaaggaagggtctccgttagatcaaccttccccaaagtacttgtacaaagtactctaccaagtactccttagtacccaaactgcaattaaacttcaaggaataagcagctgggttcatttatctcgaattaaacccatttcttatgaagtcccacaggctgagactgatctcacttatccctgtgtaccaaccactgatctctggcgcctgctcagaagaaacaagaaggatgaataacttaaagatttggattaacatcttaattctgcgcatgtattggaaccagctaagaagcaatctctttgccaaatgggcacagactttagcctccctacacaacaacactaattgctgagtatgcacggaactaatgcctcctccacctcaggctgccctggcacatcctgccagccactatgagcatatggggaaattattatgattggggtaaatggaccaccctttttcccttctactacagaaacacagggcccagccctttcccttcccaccgtgaaacaaagaagcctcttttttgtttgatcagaaaattaaactccactctgacgtaaggttatactgtacacgatgaatggatgacagctgtctaagttcaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17465 - DNA, 763 bp, synthetic construct; identical to SEQ ID NO: 606
  misc_feature 1..763: note = Synthetic polypeptide
  source 1..763: mol_type = other DNA

SEQ ID NO: 17466 - DNA, 2252 bp, synthetic construct
  misc_feature 1..2252: note = Synthetic polypeptide
  source 1..2252: mol_type = other DNA
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcaggtaagaatattaatttccttctctatacaggggctgcttgctctgttttggcacattatgaagaggctttatcatcccgagactgtatgatcacagggataaatggacaagctcataggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17467 - DNA, 170 bp, synthetic construct; identical to SEQ ID NO: 14976
  misc_feature 1..170: note = Synthetic polypeptide
  source 1..170: mol_type = other DNA

SEQ ID NO: 17468 - DNA, 459 bp, synthetic construct; identical to SEQ ID NO: 6625
  misc_feature 1..459: note = Synthetic polypeptide
  source 1..459: mol_type = other DNA

SEQ ID NO: 17469 - DNA, 2792 bp, synthetic construct; identical to SEQ ID NO: 16266
  misc_feature 1..2792: note = Synthetic polypeptide
  source 1..2792: mol_type = other DNA

SEQ ID NO: 17470 - DNA, 2130 bp, synthetic construct
  misc_feature 1..2130: note = Synthetic polypeptide
  source 1..2130: mol_type = other DNA
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17471 - DNA, 2184 bp, synthetic construct
  misc_feature 1..2184: note = Synthetic polypeptide
  source 1..2184: mol_type = other DNA
ttctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatag

SEQ ID NO: 17472 - DNA, 740 bp, synthetic construct
  misc_feature 1..740: note = Synthetic polypeptide
  source 1..740: mol_type = other DNA
ttctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtg

SEQ ID NO: 17473 - DNA, 579 bp, synthetic construct
  misc_feature 1..579: note = Synthetic polypeptide
  source 1..579: mol_type = other DNA
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggttcacttgtcaaggatgagtgtttccaattctacaaataaaaattgtattattttctag

SEQ ID NO: 17474 - DNA, 1290 bp, synthetic construct
  misc_feature 1..1290: note = Synthetic polypeptide
  source 1..1290: mol_type = other DNA
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaa

SEQ ID NO: 17475 - DNA, 621 bp, synthetic construct
  misc_feature 1..621: note = Synthetic polypeptide
  source 1..621: mol_type = other DNA
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaagaccacataccctagggaattctga

SEQ ID NO: 17476 - DNA, 1268 bp, synthetic construct
  misc_feature 1..1268: note = Synthetic polypeptide
  source 1..1268: mol_type = other DNA
ggattgtagagtcagatcgcctggctttctgtctttctcccatgggtctgggctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatga

SEQ ID NO: 17477 - DNA, 711 bp, synthetic construct; identical to SEQ ID NO: 7377
  misc_feature 1..711: note = Synthetic polypeptide
  source 1..711: mol_type = other DNA

SEQ ID NO: 17478 - DNA, 600 bp, synthetic construct
  misc_feature 1..600: note = Synthetic polypeptide
  source 1..600: mol_type = other DNA
ggatgcagagggccctgaatccaagtcctgttctgccatccaaccccaaggccctgggcggatgccgtgacctctgagcctccataattcctgtaagcgatctggagacacgagtgtccatgagaagtaaatgaaataatgcaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtga

SEQ ID NO: 17479 - DNA, 1483 bp, synthetic construct
  misc_feature 1..1483: note = Synthetic polypeptide
  source 1..1483: mol_type = other DNA
gaaataatccctaagtacctttacctcctcctttagtaaagcctgttcagcacaggggaacacacccaggtgaagattggcaaatagactacactcaaatacccccatgggaaggattcaaatatttattagtattcatcgatacctttacttgttggattgaagcttttcctacctggtctgaaaaggcaactgacatttctaaatttttattaaaggaaataatccctaagtttgggctgcctaaaagcttacagaatggctcatttttcacagcaacaagaacccaaaatatatcaccggctctaggaattcagtatcatctttattcagcatggaggccacagtttgcaggaaaagtagaaagggccaaacttcaaagaggactcttgccaagttatgccaggaaacatcagaaacctattcgtctctattgcctgtggccttgttgctagttttggctgcccctaagggaaacttgcagctcagctctttcgaaataatgtatggaagtcctttcttaactgcagatttcctagtagatatagatactttcaaattacagaactacgttattaacttaggtcgggtgcaaaaagctcttcttgaatatggaaatcagagacttcctccctccactaaggaagaaaatgctacaatccagccaggaaactgggttctattaaaaacttggaaggaagggtctccgttagatcaaccttccccaaagtacttgtacaaagtactctaccaagtactccttagtacccaaactgcaattaaacttcaaggaataagcagctgggttcatttatctcgaattaaacccatttcttatgaagtcccacaggctgagactgatctcacttatccctgtgtaccaaccactgatctctggcgcctgctcagaagaaacaagaaggatgaataacttaaagatttggattaacatcttaattctgcgcatgtattggaaccagctaagaagcaatctctttgccaaatgggcacagactttagcctccctacacaacaacactaattgctgagtatgcacggaactaatgcctcctccacctcaggctgccctggcacatcctgccagccactatgagcatatggggaaattattatgattggggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17480 - DNA, 1998 bp, synthetic construct
  misc_feature 1..1998: note = Synthetic polypeptide
  source 1..1998: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17481 - DNA, 1977 bp, synthetic construct
  misc_feature 1..1977: note = Synthetic polypeptide
  source 1..1977: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17482 - DNA, 1998 bp, synthetic construct
  misc_feature 1..1998: note = Synthetic polypeptide
  source 1..1998: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17483 - DNA, 1872 bp, synthetic construct
  misc_feature 1..1872: note = Synthetic polypeptide
  source 1..1872: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17484 - DNA, 879 bp, synthetic construct
  misc_feature 1..879: note = Synthetic polypeptide
  source 1..879: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 17485 - DNA, 1023 bp, synthetic construct
  misc_feature 1..1023: note = Synthetic polypeptide
  source 1..1023: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 17486 - DNA, 888 bp, synthetic construct
  misc_feature 1..888: note = Synthetic polypeptide
  source 1..888: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 17487 - DNA, 444 bp, synthetic construct
  misc_feature 1..444: note = Synthetic polypeptide
  source 1..444: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 17488 - DNA, 386 bp, synthetic construct
  misc_feature 1..386: note = Synthetic polypeptide
  source 1..386: mol_type = other DNA
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 17489 - DNA, 1330 bp, synthetic construct
  misc_feature 1..1330: note = Synthetic polypeptide
  source 1..1330: mol_type = other DNA
tgatatggtttggctgtgtccccactcaaatctaatcttgaattgtacccataatccccaggtgttgtgggtggatcagctggagataattgaatcatgggggcagttttccccatcgtattctcgtgatagttagttctcacgagacctaatgattttaaataaggagcttctccttttgctgggtgttcattcttctgcttgctgctgccatgtgaagaaggatgtgtttgcttccccttctgccatgatcatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaa

SEQ ID NO: 17490 - DNA, 1522 bp, synthetic construct; identical to SEQ ID NO: 15029
  misc_feature 1..1522: note = Synthetic polypeptide
  source 1..1522: mol_type = other DNA

SEQ ID NO: 17491 - DNA, 195 bp, synthetic construct; identical to SEQ ID NO: 15051
  misc_feature 1..195: note = Synthetic polypeptide
  source 1..195: mol_type = other DNA

SEQ ID NO: 17492 - DNA, 271 bp, synthetic construct
  misc_feature 1..271: note = Synthetic polypeptide
  source 1..271: mol_type = other DNA
ggccggcgcggtgactcaggcctgtaatcccagcactttgggaggccgagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactga

SEQ ID NO: 17493 - protein, 9 aa, synthetic construct
  REGION 1..9: note = synthetic polypeptide
RQAPGFHHA

SEQ ID NO: 17494 - protein, 9 aa, synthetic construct
  REGION 1..9: note = synthetic polypeptide
GLPSHVELA

SEQ ID NO: 17495 - protein, 9 aa, synthetic construct
  REGION 1..9: note = synthetic polypeptide
LLHLESFLV

SEQ ID NO: 17496 - protein, 9 aa, synthetic construct
  REGION 1..9: note = synthetic polypeptide
LLTSWHLYL
